US008058504B2

(12) United States Patent
Xu

(10) Patent No.: US 8,058,504 B2
(45) Date of Patent: Nov. 15, 2011

(54) **CLONING OF CYTOCHROME P450 GENES FROM *NICOTIANA***

(75) Inventor: Dongmei Xu, Glen Allen, VA (US)

(73) Assignee: U.S. Smokeless Tobacco Company, Richmond, VA (US)

( * ) Notice: Subject to any disclaimer, the term of this patent is extended or adjusted under 35 U.S.C. 154(b) by 0 days.

(21) Appl. No.: 12/821,273

(22) Filed: Jun. 23, 2010

(65) Prior Publication Data

US 2010/0261192 A1 Oct. 14, 2010

Related U.S. Application Data

(60) Division of application No. 10/943,507, filed on Sep. 17, 2004, now Pat. No. 7,855,318, which is a continuation-in-part of application No. 10/686,947, filed on Oct. 16, 2003, now abandoned, which is a continuation-in-part of application No. 10/387,346, filed on Mar. 12, 2003, now abandoned, which is a continuation-in-part of application No. 10/340,861, filed on Jan. 10, 2003, now abandoned, which is a continuation-in-part of application No. 10/293,252, filed on Nov. 13, 2002, now abandoned.

(60) Provisional application No. 60/347,444, filed on Jan. 11, 2002, provisional application No. 60/337,684, filed on Nov. 13, 2001, provisional application No. 60/503,989, filed on Sep. 18, 2003, provisional application No. 60/485,368, filed on Jul. 8, 2003, provisional application No. 60/418,933, filed on Oct. 16, 2002, provisional application No. 60/363,684, filed on Mar. 12, 2002.

(51) Int. Cl.
*A01H 5/00* (2006.01)
*A01H 1/00* (2006.01)
*C07H 21/04* (2006.01)

(52) U.S. Cl. ..... 800/267; 536/23.1; 536/23.2; 536/23.6; 536/24.3

(58) Field of Classification Search .................. None
See application file for complete search history.

(56) References Cited

U.S. PATENT DOCUMENTS

| | | |
|---|---|---|
| 4,693,976 A | 9/1987 | Schilperoort et al. |
| 4,732,856 A | 3/1988 | Federoff |
| 4,762,785 A | 8/1988 | Comai |
| 4,801,540 A | 1/1989 | Hiatt et al. |
| 4,801,541 A | 1/1989 | Yoneda et al. |
| 4,940,838 A | 7/1990 | Schilperoort et al. |
| 4,945,050 A | 7/1990 | Sanford et al. |
| 5,004,863 A | 4/1991 | Umbeck |
| 5,013,658 A | 5/1991 | Dooner et al. |
| 5,034,322 A | 7/1991 | Rogers et al. |
| 5,034,323 A | 7/1991 | Jorgensen et al. |
| 5,107,065 A | 4/1992 | Shewmaker et al. |
| 5,141,131 A | 8/1992 | Miller et al. |
| 5,149,645 A | 9/1992 | Hoekema et al. |
| 5,159,135 A | 10/1992 | Umbeck |
| 5,177,010 A | 1/1993 | Goldman et al. |
| 5,231,019 A | 7/1993 | Paszkowski et al. |
| 5,302,523 A | 4/1994 | Coffee et al. |
| 5,352,605 A | 10/1994 | Fraley et al. |
| 5,378,619 A | 1/1995 | Rogers |
| 5,384,253 A | 1/1995 | Krzyzek et al. |
| 5,463,174 A | 10/1995 | Moloney et al. |
| 5,464,763 A | 11/1995 | Schilperoort et al. |
| 5,464,765 A | 11/1995 | Coffee et al. |
| 5,472,869 A | 12/1995 | Krzyzek et al. |
| 5,583,021 A | 12/1996 | Dougherty et al. |
| 5,595,733 A | 1/1997 | Carswell et al. |
| 5,614,399 A | 3/1997 | Quail et al. |
| 5,641,664 A | 6/1997 | D'Halluin et al. |
| 5,679,558 A | 10/1997 | Gobel et al. |
| 5,712,135 A | 1/1998 | D'Halluin et al. |
| 5,766,900 A | 6/1998 | Shillito et al. |
| 5,929,304 A | 7/1999 | Radin et al. |
| 6,002,070 A | 12/1999 | D'Halluin et al. |
| 6,074,877 A | 6/2000 | D'Halluin et al. |
| 6,907,887 B2 | 6/2005 | Conkling |
| 6,953,040 B2 | 10/2005 | Atchley et al. |
| 7,032,601 B2 | 4/2006 | Atchley et al. |
| 2002/0042934 A1 | 4/2002 | Staub et al. |
| 2004/0103449 A1 | 5/2004 | Xu |
| 2004/0111759 A1 | 6/2004 | Xu |
| 2004/0117869 A1 | 6/2004 | Xu |
| 2004/0162420 A1 | 8/2004 | Xu |
| 2005/0132444 A1 | 6/2005 | Xu |
| 2005/0160493 A9 | 7/2005 | Ratcliffe et al. |
| 2005/0178398 A1 | 8/2005 | Breslin et al. |
| 2005/0223442 A1 | 10/2005 | Xu |
| 2005/0244521 A1 | 11/2005 | Strickland et al. |
| 2006/0037096 A1 | 2/2006 | Xu |
| 2006/0037623 A1 | 2/2006 | Lawrence |
| 2006/0041949 A1 | 2/2006 | Xu |
| 2006/0185686 A1 | 8/2006 | Lawrence |

(Continued)

FOREIGN PATENT DOCUMENTS

WO    WO 02/072758    9/2002

(Continued)

OTHER PUBLICATIONS

GenBank Accession No. AEK08729 dated Feb. 23, 2005.
EBI Accession AV557806, dated Jun. 16, 2000, 2 pages.
ARS-GRIN (PI 551280, http://www.ars-grin.gov/cgi-bin/npgs/acc/display.pl?1446216, accessed Feb. 2009).
Bartoszewski et al., "Cloning of a Wound Inducible *Lycopersicon esculentum* Cytochrome P450 Gene and Lack of Regeneration of Transgenic Plants with Sense or Antisense Constructs," *J. Am. Soc. Hort. Sci.*, 2002, 127(4):535-539.
Batard et al., "Increasing expression of P450 and P450-reductase proteins from monocots in heterologous systems," *Archives of Biochemistry and Biophysics*, 2000, 379:161-169.
Baulcombe, "Fast forward genetics based on virus-induced gene silencing," *Curr. Opin. Plant Biol.*, 1999, 2:109-113.

(Continued)

*Primary Examiner* — Brent T Page
(74) *Attorney, Agent, or Firm* — Fish & Richardson P.C.

(57) ABSTRACT

The present invention relates to p450 enzymes and nucleic acid sequences encoding p450 enzymes in *Nicotiana*, and methods of using those enzymes and nucleic acid sequences to alter plant phenotypes.

35 Claims, 24 Drawing Sheets

U.S. PATENT DOCUMENTS

| | | | |
|---|---|---|---|
| 2006/0191548 | A1 | 8/2006 | Strickland et al. |
| 2007/0149408 | A1 | 6/2007 | Thomas et al. |
| 2007/0199097 | A1 | 8/2007 | Xu et al. |
| 2007/0292871 | A1 | 12/2007 | Xu |

FOREIGN PATENT DOCUMENTS

| | | |
|---|---|---|
| WO | WO 03/078577 | 9/2003 |
| WO | WO 2004/035745 | 4/2004 |
| WO | WO 2005/038018 | 4/2005 |
| WO | WO 2005/038033 | 4/2005 |
| WO | WO 2005/046363 | 5/2005 |
| WO | WO 2005/111217 | 11/2005 |
| WO | WO 2005/116199 | 12/2005 |
| WO | WO 2006/022784 | 3/2006 |
| WO | WO 2006/091194 | 8/2006 |
| WO | WO 2006/120570 | 11/2006 |
| WO | WO 2008/076802 | 6/2008 |

OTHER PUBLICATIONS

Branch, "A good antisense molecule is hard to find," *TIBS*, 1998, 23:45-50.

Burton et al., Changes in Chemical Composition of Burley Tobacco During Senescence and Curing. 2. Acylated Pyridine Alkaloids, *J. Agric. Food Chem.*, 1988, 38(3):579-583.

Burton et al., "Distribution of Tobacco Constituents in Tobacco Leaf Tissue. 1. Tobacco-Specific Nitrosamines, Nitrate, Nitrite, and Alkaloids," *J. Agric. Food Chem.*, 1992, 40:1050-1055.

Chakrabarti et al., "Inactivation of the cytochrome P450 gene *CYP82E2* by degenerative mutations was a key event in the evolution of the alkaloid profile of modern tobacco," *New Phytologist*, 2007, 175:565-574.

Chapple et al., "Molecular-Genetic Analysis of Plant Cytochrome P450-Dependent Monooxygenases," *Annu. Rev. Plant Physiol. Plant. Mol. Biol.*, 1998, 49:311-343.

Chelvarajan et al., "Study of Nicotine Demethylation in *Nicotiana otophora*," *J. Agroc. Food Chem.*, 1993, 41:858-862.

Colliver et al., "Differential modification of flavonoid and isoflavonoid biosynthesis with an antisense chalcone synthase construct in transgenic *Lotus corniculatus*," *Plant Mol. Biol.*, 1997, 35(4):509-522.

Crookshanks et al., 28.8% identical, found in the EST Database. Accession No. BF153877 from The Potato tuber transcriptome: analysis of 6077 expressed sequence tags, *FEBS Lett.*, 2001, 506(2):123-126.

Falcón-Pérez et al., "Functional Domain Analysis of the Yeast ABC Transporter Ycf1p by Site-directed Mutagenesis," *J. Biol. Chem.*, 1999, 274(33):23584-23590.

Fannin et al., "Nicotine Demethylation in Nicotiana," *Med. Sct. Res.*, 1992, 20:867-868.

Gavilano and Siminszky, "Isolation and Characterization of the Cytochrome P450 Gene *CYP82E5v2* that Mediates Nicotine to Nornicotine Conversion in the Green Leaves of Tobacco," *Plant Cell Physiol.*, 2007, 48(11):1567-1574.

Gavilano et al. "Genetic engineering of *Nicotiana tabacum* for reduced nornicotine content" *Journal of Agricultural and Food Chemistry*, 2006, 54:9071-9078.

Gavilano et al., "Functional Analysis of Nicotine Demethylase Genes Reveals Insights into the Evolution of Modern Tobacco," *The Journal of Biological Chemistry*, 2007, 282(1):249-256.

Ghosh, "Polyamines and plant alkaloids," *Indian J. Exp. Biol.*, 2000, 38:1086-1091.

Goldrick et al., "Molecular Genetic Analysis of the User Group Associated with Two Mouse Light Chain Genetic Markers," *J. Exp. Med.*, 1985, 162:713-728.

Guo et al., "Protein Tolerance to Random Amino Acid Change," 1 *Proc. Natl. Acad. Sci. USA*, 2004, 101(25):9205-9210.

Hao and Yeoman, "Evidence in Favour of an Oxidative N-Demethylation of Nicotine to Nornicotine in Tobacco Cell Cultures," *Journal Plant Physiology*, 1998, 152:420-426.

Hao and Yeoman, "Nicotine N-Demethylase in Cell-Free Preparations from Tobacco Cell Cultures," *Phytochemistry*, 1996, 42(2):325-329.

Hao et al., "Mechanism of Nicotine N-Demethylation in Tobacco Cell Suspension Cultures," Institute of Cell and Molecular Biology, the University of Edinburgh, 1995.

Hayes et al., "Blotting techniques for the study of DNA, RNA, and proteins," *BMJ*, 1989, 299:965-968.

Hill and Preiss, "Functional analysis of conserved histidines in ADP-glucose pyrophosphorylase from *Escherichia coli*," *Biochem. Biophys. Res. Commun.*, 1998, 244:573-577.

Jack et al., "Relative stability of nicotine to nornicotine conversion in three burley cultivars," *Coresta Congress*, 2004, Kyoto, Agro-Phyto groups, Abstract AP2.

Julio et al., "Targeted Mutation Breeding as a tool for tobacco crop improvement," presentation made in Oct. 2008.

Keskin et al., "A new, structurally nonredundant, diverse data set of protein-protein interfaces and its implications," *Protein Science*, 2004, 13:1043-1055.

Lazar et al., "Transforming Growth Factor α: Mutation of Aspartic Acid 47 and Leucine 48 Results in Different Biological Activities," *Mol. Cell. Biol.*, 1988, 8(3):1247-1252.

Matthew, "RNAi for plant functional genomics," *Comp Funct Genom.*, 2004, 5:240-244.

McDougall et al., "Detection of Viral DNA and RNA by in Situ Hybridization," *J. Histochem. Cytochem.*, 1986, 34:33-38.

Mette et al., "Transcriptional silencing and promoter methylation triggered by double-stranded RNA," *EMBO J.*, 2000, 19(19):5194-5201.

Mesnard et al., "Evidence for the Involvement of Tetrahydrofolate in the Demethylation of Nicotine by *Nicotiana plumbaginifolia* Cell-Suspension Cultures," *Planta*, 2002, 214:911-919.

Ng et al., "Specific Detection and Confirmation of *Campylobacter jejuni* by DNA Hybridization and PCR," *Appl. Environ. Microbiol.*, 1997, 63(11):4558-4563.

Ohshima et al., Nucleotide sequence of the PR-1 gene of *Nicotiana tabacum*, *FEBS Letters*, 1987, 225(1,2):243-246

Plant Variety Protection Office (USDA-AMS, Beltsville, MD, http://www.ars-grin.gov/cgi-bin/npgs/html/pvp.pl?Tobbaco, accessed Feb. 2009).

Ralston et al., "Cloning, heterologous expression, and functional characterization of 5-epi-aristolochene-1,3-dihydroxylase from tobacco (*Nicotiana tabacum*)," *Arch. Biochem. Biophys.*, 2001, 393(2):222-235.

Rohr et al., "Tandem inverted repeat system for selection of effective transgenic RNAi strains of *Chlamydomonas*," *Plant J.*, 2004, 40:611-621.

Sakae et al., "Differentiation between Wild and Vaccine-Derived Strains of Poliovirus by Stringent Microplate Hybridization of PCR Products," *J. Clin. Microbiol.*, 1994, 32:202-204.

Schenk et al., "Coordinated Plant Defense Responses in *Arabidopsis* revealed by microarray analysis," *Proc. Natl. Acad. Sci. USA*, 2000, 97(21):11655-11660.

Seal et al., "Isolation of a *Pseudomonas solanacearum*-Specific DNA Probe by Subtraction Hybridization and Construction of Species-Specific Oligonucleotide Primers for Sensitive Detection by the Polymerase Chain Reaction," *Appl. Environ. Microbiol.*, 1992, 58(2):3751-3758.

Siminszky et al., "Conversion of nicotine to nornicotine in *Nicotiana tabacum* is mediated by CYP82E4, a cytochrome P450 monooxygenase," *PNAS*, 2005, 102(41):14919-14924.

Takeda et al., "Differentiation between Wild and Vaccine-Derived Strains of Poliovirus by Stringent Microplate Hybridization of PCR Products," *J. Clin. Microbiol.*, 1994, 32:202-204.

Takemoto et al., "Molecular Cloning of a Defense-Response-Related Cytochrome P450 Gene from Tobacco," *Plant Cell Physiol.*, 1999, 40(12):1232-1242.

Thomas et al., "Size constraints for targeting post-transcriptional gene directed methylation in *Nicotiana benthamiana* using a potato virus X vector," *Plant J.*, 2001, 25(4):417-425.

Thornton et al., "From structure to function: Approaches and limitations," *Nature Structural Biology, Structural Genomics Supplement*, Nov. 2000, pp. 991-994.

Wang and Wagner, "Elucidation of the functions of genes central to diterpene metabolism in tobacco trichomes using posttranscriptional gene silencing," *Planta*, 2003, 216:686-691.

Wernsman and Matzinger, "Relative Stability of Alleles at the Nicotine Conversion Locus of Tobacco," *Tobacco Sci.*, 1970, 14:34-36.

Wesley et al., "Construct design for efficient, effective and high-throughput gene silencing in plants," *The Plant Journal*, 2001, 27(6), 581-590.

Wetmur, "DNA Probes: Applications of the Principles of Nucleic Acid Hybridization," Crit. Rev. Biol. Mol. Biol., 1991, 26:227-259.

Xu et al., "Biochemical and molecular characterizations of nicotine demethylase in tobacco," *Physiologia Plantarum*, 2006, 129:307-319.

Zwart et al., "Rapid Screening for Freshwater Bacterial Groups by Using Reverse Line Blot Hybridization," *Appl. Environ. Microbiol.*, 2003, 69(10):5875-5883.

Authorized Officer Nora Lindner, International Preliminary Report on Patentability in PCT/US07/087386 mailed Jun. 25, 2009, 6 pages.

Allen et al., "RNAi-mediated replacement of morphine with the nonnarcotic alkaloid reticuline in opium poppy," *Nature Biotechnology*, 2004, 22:1559-1566.

Arndt and Rank, "Colocalization of antisense RNAs and ribozymes with their target mRNAs," *Genome*, 1997, 40:785-797.

Bak et al., "Transgenic tobacco and Arabidopsis plants expressing the two multifunctional sorghum cytochrome P450 enzymes, CYP79A1 and CYP71E1, are cyanogenic and accumulate metabolites derived from intermediates in Dhurrin biosynthesis," *Plant Physiol.*, 2000, 123:1437-1448.

Bosher and Labouesse, "RNA interference: genetic wand and genetic watchdog," *Nat. Cell Biol.*, 2000, 2:E31-E36.

Brignetti et al., "Viral pathogenicity determinants are suppressors of transgene silencing in *Nicotiana benthamiana*," *EMBO J.*, 1998, 17:6739-6746.

Byers, "Killing the messenger: new insights into nonsense-mediated mRNA decay," *J. Clin. Invest.*, 2002, 109(1):3-6.

Callis et al., "Introns increase gene expression in cultured maize cells," *Genes and Dev.*, 1987, 1:1183-1200.

Chao et al., "A silent mutation induces exon skipping in the phenylalanine hydroxylase gene in phenylketonuria," *Hum. Genet.*, 2001, 108(1):14-19.

Chappell, "Biochemistry and Molecular Biology of the Isoprenoid Biosynthetic Pathway in Plants," *Annu. Rev. Plant Physiol. Plant Mol. Biol.*, 1995, 46:521-547.

Chuang and Meyerowitz, "Specific and heritable genetic interference by double-stranded RNA in *Arabidopsis thaliana*," *Proc. Natl. Acad. Sci. USA*, 2000, 97:4985-4990.

Cogoni and Macino, "Post-transcriptional gene silencing across kingdoms," *Curr. Opin. Genet. Dev.*, 2000, 10:638-643.

Dekeyser et al., "Transient Gene Expression in Intact and Organized Rice Tissues," *Plant Cell*, 1990, 2:591-602.

Donato et al., "Fluorescence-Based Assays for Screening Nine Cytochrome P450 (P450) Activities in Intact Cells Expressing Individual Human P450 Enzymes," *Drug Metab. Dispos.*, 2004, 32(7):699-706.

Fang et al., "Multiple *cis* regulatory elements for maximal expression of the cauliflower mosaic virus 35S promoter in transgenic plants," *Plant Cell*, 1989, 1:141-150.

Fedoroff et al., "Cloning of the *bronze* locus in maize by a simple and generalizable procedure using the transposable controlling element *Activator* (Ac)," *Proc. Natl. Acad. Sci. USA*, 1984, 81:3825-3829.

Fire et al., "Potent and specific genetic interference by double-stranded RNA in *Caenorhabditis elegans*," *Nature*, 1998, 391:806-811.

Frank et al., "Cloning of Wound-Induced Cytochrome P450 Monooxygenases Expressed in Pea," *Plant Physiol.*, 1996, 110:1035-1046.

Fromm et al., "An octopine synthase enhancer element directs tissue-specific expression and binds ASF-1, a factor from tobacco nuclear extracts," *Plant Cell*, 1989, 1:977-984.

Graham-Lorence and Peterson, "P450s: structural similarities and functional differences," *FASEB J.*, 1996, 10:206-214.

Haseloff and Gerlach, "Simple RNA enzymes with new and highly specific endoribonuclease activities," *Nature*, 1988, 334:585-591.

Hélène et al., "Control of Gene Expression by Triple Helix-Forming Oligonucleotides," *Ann. N.Y. Acad. Sci.*, 1992, 660:27-36.

Hélène, "The anti-gene strategy: control of gene expression by triplex-forming-oligonucleotides," *Anti-Cancer Drug Des.*, 1991, 6:569-584.

Hildering and Verkerk, "Chimeric Structure of the Tomato Plant After Seed Treatment with EMS and X-Rays," *The Use of Induced Mutations in Plant Breeding*, 1965, Pergamon Press, pp. 317-320.

Hoekema et al., "A binary plant vector strategy based on separation of the *vir*- and T-region of the *Agrobacterium tumefaciens* Ti-plasmid," *Nature*, 1983, 303:179-180.

Ingelbrecht et al., "Posttranscriptional silencing of reporter transgenes in tobacco correlates with DNA methylation," *Proc. Natl. Acad. Sci. USA*, 1994, 91:10502-10506.

Jorgensen et al., "Chalcone synthase cosuppression phenotypes in petunia flowers: comparison of sense vs. antisense constructs and single-copy vs. complex T-DNA sequences," *Plant Mol. Biol.*, 1996, 31:957-973.

Kempin et al., "Targeted disruption in *Arabidopsis*," *Nature*, 1997, 389:802-803.

Klink and Wolniak, "The Efficacy of RNAi in the Study of the Plant Cytoskeleton," *J. Plant Growth Regul.*, 2000, 19:371-384.

Koshinsky et al., "Cre-*lox* site-specific recombination between *Arabidopsis* and tobacco chromosomes," *Plant J.*, 2000, 23(6):715-722.

Maher, "DNA Triple-Helix Formation: An Approach to Artificial Gene Repressors?" *BioEssays*, 1992, 14(12):807-815.

Maniatis et al., "Regulation of inducible and tissue-specific gene expression," *Science*, 1987, 236:1237-1245.

Maquat., "Nonsense-mediated mRNA decay," *Curr. Biol.*, 2002, 12(6):R196-R197.

Mol et al., "Regulation of plant gene expression by antisense RNA," *FEBS Lett.*, 1990, 268(2):427-430.

Napoli et al., "Introduction of a Chimeric Chalcone Synthase Gene into Petunia Results in Reversible Co-Suppression of Homologous Genes *in trans*," *Plant Cell*, 1990, 2:279-289.

Nelson et al., "Comparative Genomics of Rice and *Arabidopsis*. Analysis of 727 Cytochrome P450 Genes and Pseudogenes from a Monocot and a Dicot," *Plant Physiology*, 2004, 135:756-772.

Nelson et al., "Comparison of cytochrome P450 (*CYP*) genes from the mouse and human genomes, including nomenclature recommendations for genes, pseudogenes and alternative-splice variants," *Pharmacogenetics*, 2004, 14(1):1-18.

Odell et al., "Identification of DNA sequences required for activity of the cauliflower mosaic virus 35S promoter," *Nature*, 1985, 313:810-812.

Reid and Haley, "Studies on the Fermentation of Tobacco 1. The Microflora of Cured and Fermenting Cigar-leaf Tobacco," Bulletin 356, 1938, Pennsylvania Agricultural Experiment Station, State College, PA.

Rodermel et al., "Nuclear-Organelle Interactions: Nuclear Antisense Gene Inhibits Ribulose Bisphosphate Carboxylase Enzyme Levels in Transformed Tobacco Plants," *Cell*, 1988, 55:673-681.

Schopfer and Ebel, "Identification of elicitor-induced cytochrome P450s of soybean (*Glycine max* L.) using differential display of mRNA," *Mol. Gen. Genet.*, 1998, 258:315-322.

Smith et al., "Total silencing by intron-spliced hairpin RNAs," *Nature*, 2000, 407:319-320.

Tavernarakis et al., "Heritable and inducible genetic interference by double-stranded RNA encoded by transgenes," *Nat. Genet.*, 2000, 24:180-183.

Toscano et al., "A silent mutation (2939G>A, exon 6; CYP2D6 59) leading to impaired expression and function of CYP2D6," *Pharmacogenet Genomics*, 2006, 16(10):767-7670.

Turner and Schuch, "Post-transcriptional gene-silencing and RNA interference: genetic immunity, mechanisms and applications," *J. Chem. Technol. Biotechnol.*, 2000, 75:869-882.

United States, "Tobacco in the United States," Miscellaneous Publication No. 867, 1979, U.S. Dept. of Agriculture, Agricultural Marketing Service.

van der Krol et al., "Antisense genes in plants: an overview," *Gene*, 1988, 72:45-50.

Vaucheret et al., "Post-transcriptional gene silencing in plants," *J. Cell Sci.*, 2001, 114:3083-3091.

Verdaguer et al., "Functional organization of the cassava vein mosaic virus (CsVMV) promoter," *Plant Mol. Biol.*, 1998, 37(6):1055-1067.

Verkerk, "Chimerism of the tomato plant after seed irradiation with fast neutrons," *Neth. J. Agric. Sci.*, 1971, 19:197-203.

Voss et al., "The role of enhancers in the regulation of cell-type-specific transcriptional control," *Trends Biochem. Sci.*, 1986, 11(7):287-289.

Wang et al., "Suppression of a P450 hydroxylase gene in plant trichome glands enhances natural-product-based aphid resistance," *Nat. Biotechnol.*, 2001, 19:371-374.

Wang et al., "Isolation and characterization of the CYP71D16 trichome-specific promoter from *Nicotania tabacum* L" *Journal of Experimental Botany*, 2002, 53(376):1891-1897.

Waterhouse et al., "Virus resistance and gene silencing in plants can be induced by simultaneous expression of sense and antisense RNA," *Proc. Natl. Acad. Sci. USA*, 1998, 95:13959-13964.

Weigel and Nilsson, "A developmental switch sufficient for flower initiation in diverse plants," *Nature*, 1995, 377:495-500.

Werck-Reichhart and Feyereisen, "Cytochromes P450: a success story," *Genome Biology*, 2000, 1(6):3003.1-3003.9.

Werck-Reichhart et al., "Cytochromes P450," *The Arabidopsis Book*, 2002, American Society of Plant Biologists.

Whitbred and Schuler, "Molecular Characterization of *CYP73A9* and *CYP82A1* P450 Genes Involved in Plant Defense in Pea," *Plant Physiol.*, 2000, 124:47-58.

Figure 1: Amino Acid Identity of Group Members

Group 1

```
AQLAINLVTSMLGHLLHHFTWAPAPGVNPEDIDLEESPGTVTYMKNPIQAIPTPRLPAHLYGRVPVDM    SEQ ID No.:2   D58-BG7
                |                                                                    (98.5)
AQLAINLVTSMLGHLLHHFTWAPPPGVNPENIDLEESPGTVTYMKNPIQAIPTPRLPAHLYGRVPVDM    SEQ ID No.:4   D58-AB1
```

Group 2

```
QLAINLVTSMLGHLFIILHGLRPRGLTRRILTWRRALEQ                                 SEQ ID No.:8   D58-BE4
```

Group 3

```
EGLAVRMVALSLGCIIQCFDWQRIGEELVDMTEGTGLTLPKAQPLVAKCSPRPKMANLLSQI          SEQ ID No.:10  D56-AH7
   |                  | |                         |                                   (93.5)
EGLAIRMVALSLGCIIQCFDWQRLGEGLVDKTEGTGLTLPKAQPLVAKCSPRPIMANLLSQI          SEQ ID No.:12  D13a-5
```

Group 4

```
IGFATLVTHLTFGRLLQGFDFSKPSNTPIDMTEGVGVTLPKVNQVEVLITPRLPSKLYLF            SEQ ID No.:14  D56-AG10
 |                    |                         |       |                             (93.3)
INPATLVTHLTFGRLLQGFDFSTPSNTPIDMTEGVGVTLPKVNQVEVLISPRLPSKLYVF            SEQ ID No.:18  D34-62
```

Group 5

```
IILALPILGITLGRLVQNFELLPPPGQSKLDTTEKGGQFSLHILKHSTIVLKPRSF                SEQ ID No.:20  D56-AA7
                                                 |                                    (98.2)
IILALPILGITLGRLVQNFELLPPPGQSKLDTTEKGGQFSLHILKHSTIVMKPRSF                SEQ ID No.:144 D185-BD3
                                                 | |                                  (96.4)
IILALPILGITLGRLVQNFELLPPPGQSKLDTTEKGGQFSLHILKHSTIVLKPRSC                SEQ ID No.:22  D56-AE1
```

Group 6

```
IALGVASMELALSNLLYAFDWELPFGMKKEDIDTNARPGITMHKKNELYLIPKNYL                SEQ ID No.:24  D35-BB7
              ||       |         |                                                    (92.8)
IALGVASMELALSNLLYAFDWELPYGVKKENIDTNVRPGITMHKKNELCLIPRNYL                SEQ ID No.:26  D177-BA7
                                        |         |                                   (96.4)
IALGVASMELALSNLLYAFDWELPYGVKKEDIDTNVRPGIAMHKKNELCLVPKNYL                SEQ ID No.:28  D56-AB6
                                                     |||                              (94.6)
IALGVASMELALSNLLYAFDWELPYGVKKEDIDTNVRPGIAMHKKNELCLVPKKLFINYIGTWISC      SEQ ID No.:30  D144-AE2
```

Group 7

```
ISFGLANAYLPLAQLLYHFDWELPTGIKPSDLDLTELVGVTAARKSDLYLVATPYQPPQN            SEQ ID No.:32  D56-AG11
    |||              |                                    |                           (93.3)
ISFGLANAYLPLAQLLYHFDWKLPAGIEPSDLDLTELVGVTAARKSDLYLVATPYQPPQK            SEQ ID No.:34  D179-AA1
```

Group 8

```
MLFGLANVGQPLAQLLYHFDWKLPNGQSHENFDMTESPGISATRKDDLVLIATPYDSY              SEQ ID No.:36  D56-AC7
          ||                     |          ||                                        (91.2)
MLFGLANVGQPLAQLLYHFDWKLPNGQTHQNFDMTESPGISATRKDDLILIATPAHS               SEQ ID No.:38  D144-AD1
```

Figure 1 (continued):

Group 9
LLFGLVNVGHPLAQLLYHFDWKTLPGISSDSFDMTETDGVTAGRKDDLCLIATPFGLN     SEQ ID No.:40 D144-AB5

Group 10
MSFGLVNTGHPLAQLLYFFDWKFPHKVNAADFHTTETSRVFAASKDDLYLIPTNHMEQE     SEQ ID No.:42 D181-AB5
                           |    ||    ||                                |              (89.8)
MSFGLVNTGHPLAQLLYCFDWKLPDKVNANDFRTTETSRVFAASKDDLYLIPTNHREQE     SEQ ID No.:44 D73-Ac9

Group 11
MQPGLALVTLPLAHLLHNFDWKLPEGINARDLDMTEANGISARREKDLYLIATPYVSPLD     SEQ ID No.:46 D56-AC12

Group 12
MTYALQVEHLTMAHLIQGFNYRTPTDEPLDMKEGAGITIRKVNPVKVIITPRLAPELY     SEQ ID No.:48 D58-AB9
              | ||                                || |                     (89.6)
MTYALQVEHLTMAHLIQGFNYKTPNDEALDMKEGAGITIRKVNPVELIIAPRLAPELY     SEQ ID No.:50 D56-AG9
                                                                              |                               (98.2)
MTYALQVEHLTMAHLIQGFNYKTPNDEALDMKEGAGITIRKVNPVELIITPRLAPELY     SEQ ID No.:52 D56-AG6
                         |              |                         |                         (94.8)
MTYALQVEHLTMAHLIQGFNYRTPNDEPLDMKEGAGITIRKVNPVELIIAPRLAPELY     SEQ ID No.:54 D35-BG11
                                                                                             |                 (98.3)
MTYALQVEHLTMAHLIQGFNYRTPNDEPLDMKEGAGITIRKVNPVELIIAP-LAPELY     SEQ ID No.:56 D35-42
                                                                                        |                        (98.3)
MTYALQVEHLTMAHLIQGFNYRTPNDEPLDMKEGAGITIRKVNPAELIIAPRLAPELY     SEQ ID No.:58 D35-BA3
       |          |                           |             | |||||                  (84.5)
MTYALQVEHLTIAHLIQGFNYKTPNDEPLDMKEGAGLTIRKVNPVEVTTTARLAPELY     SEQ ID No.:60 D34-57
                                                                                                  |                 (98.3)
MTYALQVEHLTIAHLIQGFNYKTPNDEPLDMKEGAGLTIRKVNPVEVTITARLAPELY     SEQ ID No.:62 D34-52

Group 13
YSLGLKVIRVTLANMLHGFNWKLPEGMKPEDISVEEHYGLTTHPKFPVPVILESRLSSDLYSPIT     SEQ ID No.:66 D56-AD10

Group 14
YSLGIRIIRATLANLLHGFNWRLPNGMSPEDISMEEIYGLITHPKVALDVMMEPRLPNHLYK     SEQ ID No.:68 D56-AA11

Group 15
INPSIPLVELALANLLFHYNWSLPEGMLAKDVDMEEALGITMHKKSPLCLVASHYTC     SEQ ID No.:70 D177-BD5
                                         |                                     ||               (94.7)
INPSIPLVELALANLLFHYNWSLPEGMLPKDVDMEEALGITMHKKSPLCLVASHYNLL     SEQ ID No.:84 D177-BD7

Group 16
MQLGLYALEMAVAHLLLCFTWELPDGMKPSELKMDDIFGLTAPRANRLVAVPSPRLLCPLY     SEQ ID No.:74 D58-BC5
               |                                                            |                    (96.7)
MQLGLYALEMAVAHLLHCFTWELPDGMKPSELKMDDIFGLTAPRANRLVAVPTPRLLCPLY     SEQ ID No.:76 D58-AD12
                                                                    |                           (98.4)
MQLGLYALEMAVAHLLHCFTWELPDGMKPSELKMDDIFGLTAPKANRLVAVPTPRLLCPLY     SEQ ID No.:72 D56A-AG10

Group 17
MLWSASIVRVSYLTCIYRFQVYAGSVFRVA     SEQ ID No.:78 D56-AC11

Figure 1 (continued):

```
                                                                                     (96.7)
MLWSASIVRVSYLTCIYRFQVYAGSVSRVA                                          SEQ ID No.:88 D56-AD6F

Group 18
LNFAMLEAKMALALILQHYAFELSPSYAHAPHTIITLQPQHGAPLILRKL                      SEQ ID No.:90 D73A-AD6

Group 19
QNFAILEAKMAIAMILQRFSPELSPSYTHSPYTVVTLKPKYGAPLIMHRL                      SEQ ID No.:96 D70A-AB5
    ||                | | |||| || |        | |
                                                                                     (72.0)
QNFAMLEAKMALSMILQRFSPELSPSYAHAPQSILTVQPQYGAPLIFHKL                      SEQ ID No.:100 D70A-AB8
 |    |   ||               |    | ||         |
                                                                                     (82.0)
INFAMTEAKMAMAMILQRFSPELSPSYTHAPQSVITMQPQYGAPLILHKL                      SEQ ID No.:102 D70A-BH2
    |
                                                                                     (98.0)
INFAMAEAKMAMAMILQRFSPELSPSYTHAPQSVITMQPQYGAPLILHKL                      SEQ ID No.:104 D70A-AA4
 |   |   |  ||              |||| ||          ||||
                                                                                     (70.0)
QNFAMMEAKMAVAMILHKFSPELSPSYTHAPFAIVTIHPQYGAPLLMRRL                      SEQ ID No.:108 D70A-BA9
           |
                                                                                     (98.0)
QNFAMMEAKMAVAMILQKFSPELSPSYTHAPFAIVTIHPQYGAPLLMRRL                      SEQ ID No.:106 D70A-BA1

Group 20
QNFAMLEAKMAMAMILKTYAFELSPSYAHAPHPLLLQPQYGAQLILYKL                       SEQ ID No.:110 D70A-BD4

Group 21
YSMGLKAIQASLANLLHGFNWSLPDNMTPEDLNMDEIFGLSTPKKFPLATVIEPRLSPKLYSV         SEQ ID No.:112 D181-AC5
 | |
                                                                                     (96.8)
YSLGLKEIQASLANLLHGFNWSLPDNMTPEDLNMDEIFGLSTPKKFPLATVIEPRLSPKLYSV         SEQ ID No.:114 D144-AH1
 |  |
                                                                                     (96.8)
HSLGLKVIQASLANLLHGFNWSLPDNMTPEDLNMDEIFGLSTPKKFPLATVIEPRLSPKLYSV         SEQ ID No.:116 D34-65

Group 22
LCFPCLISSYILALNVNLYHNFLQISPSISY                                         SEQ ID No.:118 D35-BG2

Group 23
SGLAQCVVGLALATLVQCFEWKRVSEEVVDLTEGKGLTMPKPEPLMARCEARDIFHKVLSEIS         SEQ ID No.:120 D73A-AH7

Group 24
LGLATVHVNLMLARMIQEFEWSAYPENRKVDLLRNWNLLW                                SEQ ID No.:136 D185-BG2
             ||||||||||
                                                                                     (77.5)
LGLATVHVNLMLARMIQEFEWSAYPENRKVDFTEKLEFTVVMKNPLRAKVKPRMQVV               SEQ ID No.:122 D58-AA1
              |
                                                                                     (98.2)
LGLATVHVNLMLARTIQEFEWSAYPENRKVDFTEKLEFTVVMKNPLRAKVKPRMQVV               SEQ ID No.:134 D185-BC1
```

Figure 1 (continued):

Group 25
YALAMLHLEYFVANLVWHFRWEAVEGDDVDLSEKLEFTVVMKNPLRARICPRVNSI                SEQ ID No.:124 D73A-AE10

Group 26
QQVGLLRTTIFIASLLSEYKLKPRSHQKQVELTDLNPASWLHSIKGELLVDAIPRKKAAF            SEQ ID No.:126 D56A-AC12

Group 27
ITFAKFVNELALARLMFHFDFSLPKGVKHEDLDVEEAAGITVRRKFPLLAVATPCS                SEQ ID No.:128 D177-BF7
                           |                                                              (98.2)
ITFAKFVNELALARLMFHFDFSLPKGVKHADLDVEEAAGITVRRKFPLLAVATPCS                SEQ ID No.:140 D185-BD2

Group 28
QRYAINHLMLFIALFTALIDFKRHKTDGCDDIAYIPTIAPKDDCKVFLSQRCTRFPSFS             SEQ ID No.:130 D73A-AG3

Group 29
MSFGLANLYLPLAQLLYHFDWKLPTGIKPRDLDLTELSGITIARKGDLYLNATPYQPSRE            SEQ ID No.:132 D70A-AA12
|                      ||| |  |  | |  |   |   |  ||                                           (80.0)
ISFGLANVYLPLAQLLYHFDWKLPTGINSSDLDMTESSGVTCARKSDLYLTATPYQLSQE            SEQ ID No.:86 176-BF2

Group 30                                                            SEQ ID No.:146 D176-BC3
QNFAMLEAKTTLAMILQRFSFELSPSYAHAPQSIITCNPSMVLHLFCIKYSLLLVSSVSFYVKHESKMLRLVELQNGNAFALVHCRLL

Group 31
ADMGLRAVSLALGALIQCFDWQIEEAESLEESYNSRMTMQNKPLKVVCTPREDLGQLLSQL           SEQ ID No.:148 D176-BB3

Group 32
MNYSLQVEHLSIAHMIQGFSFATTTNEPLDMKQGVGLTLPKKTDVEVLITPRLPPTLYQY            SEQ ID No.:6 D186-AH4

The percentage identity between most related pairs is noted in (0.0%). Each group had at
least 70% identity to another group member. Group 19 contained the lowest percentage
identity at 70.0%.

FIGURE 2: COMPARISON OF SEQUENCE GROUPS

ALIGNMENT OF GROUP 1

```
D58-BG7      GCACAACTTGCTATCAACTTGGTCACATCTATGTTGGGTCATTTGTTGCATCATTTTACA    SEQ ID No 1
                                                         |
D58-AB1      GCACAACTTGCTATCAACTTGGTCACATCTATGTTGGGTCATTTGTTGCATCATTTTACG    SEQ ID No 3
                                                         |
D58-BE4      GCACAACTTGCTATCAACTTGGTCACATCTATGTTGGGTCATTTGTT-CATCATTTTACA    SEQ ID No 7
             ************************************************ ***********

D58-BG7      TGGGCTCCGGCCCCGGGGGTTAACCCGGAGGATATTGACTTGGAGGAGAGCCCTGGAACA
                     |              |
D58-AB1      TGGGCTCCGCCCCCGGGGGTTAACCCGGAGAATATTGACTTGGAGGAGAGCCCTGGAACA
                     |              |
D58-BE4      TGGGCTCCGGCCCCGGGGGTTAACCCGGAGGATATTGACTTGGAGGAGAGCCCTGGAACA
             ********* ******************* ******************************

D58-BG7      GTAACTTACATGAAAAATCCAATACAAGCTATTCCAACTCCAAGATTGCCTGCACACTTG
                                                  |
D58-AB1      GTAACTTACATGAAAAATCCAATACAAGCTATTCCTACTCCAAGATTGCCTGCACACTTG]
             ||||||||||||||||||||||||||||||||||| ||||||||||||||||||||||||
D58-BE4      GTAACTTACATGA-----------------------------------------------
             *************

D58-BG7      TATGGACGTGTGCCAGTGGATATGTAA

D58-AB1      TATGGACGTGTGCCAGTGGATATGTAA
             |||||||||||||||||||||||||||
D58-BE4      ---------------------------
```

PERCENT IDENTITY OF GROUP 1

|         | D58-BG7 | D58-BE4 | D58-AB1 |          |
|---------|---------|---------|---------|----------|
| D58-BG7 | ***     | 96.2    | 98.1    | SEQ ID No 1 |
| D58-BE4 |         | ***     | 94.0    | SEQ ID No 7 |
| D58-AB1 |         |         | ***     | SEQ ID No 3 |

ALIGNMENT OF GROUP 2

```
D56-AH7      GAAGGATTGGCTGTTCGAATGGTTGCCTTGTCATTGGGATGTATTATTCAATGTTTTGAT    SEQ ID No 9
                         |          |                          |
D13a-5       GAAGGATTGGCTATTCGAATGGTTGCATTGTCATTGGGATGTATTATTCAATGCTTTGAT    SEQ ID No 11
             ************ ************ *************************** ******

D56-AH7      TGGCAACGAATCGGCGAAGAATTGGTTGATATGACTGAAGGAACTGGACTTACTTTGCCT
                      |  |   |    |
D13a-5       TGGCAACGACTTGGGGAAGGATTGGTTGATAAGACTGAAGGAACTGGACTTACTTTGCCT
             ********* *  * **** ********** *****************************

D56-AH7      AAAGCTCAACCTTTGGTGGCCAAGTGTAGCCCACGACCTAAAATGGCTAATCTTCTCTCT
                           |                       |             |
D13a-5       AAAGCTCAACCTTTAGTGGCCAAGTGTAGCCCACGACCTATAATGGCTAATCTTCTTTCT
             ************** ************************ **************** ***

D56-AH7      CAGATTTGA

D13a-5       CAGATTTGA
             *********
```

PERCENT IDENTITY OF GROUP 2

|         | D56-AH7 | D13a-5 |              |
|---------|---------|--------|--------------|
| D56-AH7 | ***     | 93.7   | SEQ ID No 9  |
| D13a-5  |         | ***    | SEQ ID No 11 |

FIGURE 2: COMPARISON OF SEQUENCE GROUPS (continued)

ALIGNMENT OF GROUP 3

```
D56-AG10    ATAGGTTTTGCGACTTTAGTGACACATCTGACTTTTGGTCGCTTGCTTCAAGGTTTTGAT   SEQ ID No 13
D35-33      ATAGGCTTTGCGACTTTAGTGACACATCTGACTTTTGGTCGCTTGCTTCAAGGTTTTGAT   SEQ ID No 15
D34-62      ATAAATTTTGCGACTTTAGTGACACATCTGACTTTTGGTCGCTTGCTTCAAGGTTTTGAT   SEQ ID No 17

D56-AG10    TTTAGTAAGCCATCAAACACGCCAATTGACATGACAGAAGGCGTAGGCGTTACTTTGCCT
D35-33      TTTAGTAAGCCATCAAACACGCCAATTGACATGACAGAAGGCGTAGGCGTTACTTTGCCT
D34-62      TTTAGTACGCCATCAAACACGCCAATAGACATGACAGAAGGCGTAGGCGTTACTTTGCCT

D56-AG10    AAGGTTAATCAAGTTGAAGTTCTAATTACCCCTCGTTTACCTTCTAAGCTTTATTTATTTTGA
D35-33      AAGGTTAATCAAGTTGAAGTTCTAATTACCCCTCGTTTACCTTCTAAGCTTTATTTAT-----
D34-62      AAGGTAAATCAAGTGGAAGTTCTAATTAGCCCTCGTTTACCTTCTAAGCTTTATGTATTCTGA
```

PERCENT IDENTITY OF GROUP 3

|         | D56-AG10 | D35-33 | D34-62 |              |
|---------|----------|--------|--------|--------------|
| D56-AG10| ***      | 98.9   | 95.1   | SEQ ID No 13 |
| D35-33  |          | ***    | 94.4   | SEQ ID No 15 |
| D34-62  |          |        | ***    | SEQ ID No 17 |

ALIGNMENT OF GROUP 4

```
D56-AA7     ATTATACTTGCATTGCCAATTCTTGGCATCACTTTGGGACGTTTGGTTCAGAACTTTGAG
D56-AE1     ATTATACTTGCATTGCCAATTCTTGGCATTACTTTGGGACGTTTGGTTCAGAACTTTGAG
D185-BD3    ATTATCCTTGCACTGCCAATTCTTGGCATTACCTTGGGACGCTTGGTGCAGAACTTTGAG

D56-AA7     CTGTTGCCTCCTCCAGGCCAGTCGAAGCTCGACACCACAGAGAAAGGTGGACAGTTCAGT
D56-AE1     CTGTTGCCTCCTCCAGGCCAGTCGAAGCTCGACACCACAGAGAAAGGTGGACAGTTCAGT
D185-BD3    TTGTTGCCTCCTCCAGGACAGTCAAAGCTTGACACAACAGAGAAAGGCGGGCAATTCAGT

D56-AA7     CTCCACATTTTGAAGCATTCCACCATTGTGTTGAAACCAAGGTCTTTCTGA
D56-AE1     CTCCATATTTTGAAGCATTCCACCATTGTGTTGAAACCAAGGTCTTGCTGA
D185-BD3    CTGCACATTTTGAAGCATTCCACCATTGTGATGAAACCAAGATCTTTTTAA
```

PERCENT IDENTITY OF GROUP 4

|         | D56AA7 | D56-AE1 | D185-BD3 |               |
|---------|--------|---------|----------|---------------|
| D56AA7  | ***    | 98.2    | 87.7     | SEQ ID No 19  |
| D56-AE1 |        | ***     | 87.1     | SEQ ID No 21  |
| D185-BD3|        |         | ***      | SEQ ID No 143 |

FIGURE 2: COMPARISON OF SEQUENCE GROUPS
(continued)

ALIGNMENT OF GROUP 5

```
D56A-AB6    ATTGCACTTGGGGTTGCATCCATGGAACTTGCTTTGTCAAATCTTCTTTATGCATTTGAT   SEQ ID No 27
D35-BB7     ATTGCACTTGGGGTTGCATCAATGGAACTTGCATTGTCAAATCTTCTTTATGCATTTGAT   SEQ ID No 23
D177-BA7    ATTGCACTTGGGGTTGCATCCATGGAACTTGCTTTGTCAAATCTTCTTTATGCATTTGAT   SEQ ID No 25
D144-AE2    ATTGCACTTGGGGTTGCATCCATGGAACTTGCTTTGTCAAATCTTCTTTATGCATTTGAT   SEQ ID No 29

D56A-AB6    TGGGAGTTGCCTTATGGAGTGAAAAAAGAAGACATCGACACAAACGTTAGGCCTGGAATT
D35-BB7     TGGGAGTTACCTTTTGGAATGAAAAAAGAAGACATTGACACAAACGCCAGGCCTGGAATT
D177-BA7    TGGGAGTTACCTTACGGAGTGAAAAAAGAAAACATTGACACAAATGTCAGGCCTGGAATT
D144-AE2    TGGGAGTTGCCTTATGGAGTGAAAAAAGAAGACATCGACACAAACGTTAGGCCTGGAATT

D56A-AB6    GCCATGCACAAGAAAAACGAACTTTGCCTTGTCCCAAAAAA-TTATTTATAA-----
D35-BB7     ACCATGCATAAGAAAAACGAACTTTATCTTATCCCTAAAAA-TTATCTATAG-----
D177-BA7    ACCATGCATAAGAAAAACGAACTTTGCCTTATCCCTAGAAA-TTATCTATAG-----
D144-AE2    GCCATGCACAAGAAAAACGAACTTTGCCTTGTCCCAAAAAAATTATTTATAAATTAT

D56A-AB6    -----------------------
D35-BB7     -----------------------
D177-BA7    -----------------------
D144-AE2    ATTGGGACGTGGATCTCATGCTAG
```

PERCENT IDENTITY OF GROUP 5

|          | D56A-AB6 | D35-BB7 | D144-AE2 | D177-BA7 |           |
|----------|----------|---------|----------|----------|-----------|
| D56A-AB6 | ***      | 90.6    | 97.1     | 91.8     | SEQ ID No 27 |
| D35-BB7  |          | ***     | 87.7     | 93.0     | SEQ ID No 23 |
| D144-AE2 |          |         | ***      | 88.9     | SEQ ID No 29 |
| D177-BA7 |          |         |          | ***      | SEQ ID No 25 |

ALIGNMENT OF GROUP 6

```
D56-AG11    ATTTCGTTTGGTTTAGCTAATGCTTATTTGCCATTGGCTCAATTACTTTATCACTTTGAT
D179-AA1    ATTTCGTTTGGCTTAGCTAATGCTTATTTGCCATTGGCTCAATTACTATATCACTTCGAT

D56-AG11    TGGGAACTCCCCACTGGAATCAAACCAAGCGACTTGGACTTGACTGAGTTGGTTGGAGTA
D179-AA1    TGGAAACTCCCTGCTGGAATCGAACCAAGCGACTTGGACTTGACTGAGTTGGTTGGAGTA

D56-AG11    ACTGCCGCTAGAAAAAGTGACCTTTACTTGGTTGCGACTCCTTATCAACCTCCTCAAAACTGA
D179-AA1    ACTGCCGCTAGAAAAAGTGACCTTTACTTGGTTGCGACTCCTTATCAACCTCCTCAAAAGTGA
```

FIGURE 2: COMPARISON OF SEQUENCE GROUPS (continued)

PERCENT IDENTITY OF GROUP 6

```
           SEQ ID No 31    SEQ ID No 33
           D56-AG11        D179-AA1
D56-AG11   ***             95.6           SEQ ID No 31
D179-AA1                   ***            SEQ ID No 33
```

ALIGNMENT OF GROUP 7

```
D56-AC7    ATGCTATTTGGTTTAGCTAATGTTGGACAACCTTTAGCTCAGTTACTTTATCACTTCGAT    SEQ ID No 35

D144-AD1   ATGCTATTTGGTTTAGCTAATGTTGGACAACCTTTAGCTCAGTTACTTTATCACTTCGAT    SEQ ID No 37
           ************************************************************

D56-AC7    TGGAAACTCCCTAATGGACAAAGTCATGAGAATTTCGACATGACTGAGTCACCTGGAATT
                                 |  ||  |
D144-AD1   TGGAAACTCCCTAATGGACAAACTCACCAAAATTTCGACATGACTGAGTCACCTGGAATT
           ********************  ***  * *******************************

D56-AC7    TCTGCTACAAGAAAGGATGATCTTGTTTTGATTGCCACTCCTTATGATTCTTATTAA
                                    |              || |
D144-AD1   TCTGCTACAAGAAAGGATGATCTTATTTTGATTGCCACTCCTGCTCATTCTTGA
           ************************ *****************  *  ******
```

PERCENT IDENTITY OF GROUP 7

```
           D144-AD1    D56-AC7
D144-AD1   ***         94.3        SEQ ID No 37
D56-AC7F               ***         SEQ ID No 35
```

ALIGNMENT OF GROUP 9

```
D181-AB5   ATGTCGTTTGGTTTAGTTAACACTGGGCATCCTTTAGCTCAGTTGCTCTATTTCTTTGAC    SEQ ID No 41
                                |             |              |
D73-AC9    ATGTCGTTTGGTTTAGTTAACACAGGGCATCCTTTAGCCCAGTTGCTCTATTGCTTTGAC    SEQ ID No 43
           ********************** ************** ************* ******

D181-AB5   TGGAAATTCCCTCATAAGGTTAATGCAGCTGATTTTCACACTACTGAAACAAGTAGAGTT
                |   ||         |       ||   |
D73-AC9    TGGAAACTCCCTGACAAGGTTAATGCAAATGATTTTCGCACTACTGAAACAAGTAGAGTT
           ******  ****  * *********** *  ******* *********************

D181-AB5   TTTGCAGCAAGCAAAGATGACCTCTACTTGATTCCAACAAATCACATGGAGCAAGAGTAG
                                                    |     |        |
D73-AC9    TTTGCAGCAAGCAAAGATGACCTCTACTTGATTCCCACAAATCACAGGGAGCAAGAATAG
           *********************************** ********* ********* ***
```

PERCENT IDENTITY OF GROUP 9

```
           D181-AB5    D73-AC9
D181-AB5   ***         92.8        SEQ ID No 41
D73-AC9                ***         SEQ ID No 43
```

FIGURE 2: COMPARISON OF SEQUENCE GROUPS (continued)

ALIGNMENT OF GROUP 11

| | | |
|---|---|---|
| D58-AB9 | ATGACTTATGCATTGCAAGTGGAACACCTAACAATGGCACATTTGATCCAGGGTTTCAAT | SEQ ID No 47 |
| D56-AG9 | ATGACTTATGCATTGCAAGTGGAACACCTAACAATGGCACATTTAATCCAGGGTTTCAAT | SEQ ID No 49 |
| D35-BG11 | ATGACTTATGCATTGCAAGTGGAACACTTAACAATGGCACATTTGATCCAAGGTTTCAAT | SEQ ID No 53 |
| D34-25 | ATGACTTATGCATTACAAGTGGAACACCTAACAATAGCACATTTGATCCAGGGTTTCAAT | SEQ ID No 63 |
| D35-BA3 | ATGACTTATGCATTGCAAGTGGAACACTTAACAATGGCACATTTGATCCAAGGTTTCAAT | SEQ ID No 57 |
| D34-52 | ATGACTTATGCATTACAAGTGGAACACCTAACAATAGCACATTTGATCCAGGGTTTCAAT | SEQ ID No 61 |
| D56-AG6 | ATGACTTATGCATTGCAAGTGGAACACCTAACAATGGCACATTTAATCCAGGGTTTCAAT | SEQ ID No 51 |
| D35-42 | ATGACTTATGCATTGCAAGTGGAACACTTAACAATGGCACATTTGATCCAAGGTTTCAAT | SEQ ID No 55 |
| D34-57 | ATGACTTATGCATTACAAGTGGAACACCTAACAATAGCACATTTGATCCAGGGTTTCAAT | SEQ ID No 59 |

| | |
|---|---|
| D58-AB9 | TACAGAACTCCAACTGATGAGCCCTTGGATATGAAAGAAGGTGCAGGCATAACTATACGT |
| D56-AG9 | TACAAAACTCCAAATGACGAGGCCTTGGATATGAAGGAAGGTGCAGGCATAACTATACGT |
| D35-BG11 | TACAGAACTCCAAATGACGAGCCCTTGGATATGAAGGAAGGTGCAGGCATAACTATACGT |
| D34-25 | TACAAAACTCCAAATGACGAGCCCCTGGATATGAAGGAAGGTGCAGGATTAACTATACGT |
| D35-BA3 | TACAGAACTCCAAATGACGAGCCCTTGGATATGAAGGAAGGTGCAGGCATAACTATACGT |
| D34-52 | TACAAAACTCCAAATGACGAGCCCTTGGATATGAAGGAAGGTGCAGGATTAACTATACGT |
| D56-AG6 | TACAAAACTCCAAATGACGAGGCCTTGGATATGAAGGAAGGTGCAGGCATAACAATACGT |
| D35-42 | TACAGAACTCCAAATGACGAGCCCTTGGATATGAAGGAAGGTGCAGGCATAACTATACGT |
| D34-57 | TACAAAACTCCAAATGACGAGCCCTTGGATATGAAGGAAGGTGCAGGATTAACCATACGT |

| | |
|---|---|
| D58-AB9 | AAGGTAAATCCTGTGAAAGTGATAATTACGCCTCGCTTGGCACCTGAGCTTTATTAA |
| D56-AG9 | AAGGTAAATCCTGTGGAACTGATAATAGCGCCTCGCCTGGCACCTGAGCTTTATTAA |
| D35-BG11 | AAGGTAAATCCTGTGGAACTGATAATAGCGCCTCGCCTGGCACCTGAGCTTTATTAA |
| D34-25 | AAAGTAAATCCTGTAGAAGTGACAATTACGGCTCGCCTGGCACCTGAGCTTTATTAA |
| D35-BA3 | AAGGTAAATCCTGCGGAACTGATAATAGCGCCTCGCCTGGCACCTGAGCTTTATTAA |
| D34-52 | AAAGTAAATCCTGTAGAAGTGACAATTACGGCTCGCCTGGCACCTGAGCTTTATTAA |
| D56-AG6 | AAGGTAAATCCAGTGGAATTGATAATAACGCCTCGCTTGGCACCTGAGCTTTACTAA |
| D35-42 | AAGGTAAATCCTGTGGAACTGATAATAGCGCCCC---TGGCACCTGAGCTTTATTAA |
| D34-57 | AAAGTAAATCCTGTAGAAGTGACAACTACGGCTCGCCTGGCACCTGAGCTTTATTAA |

FIGURE 2: COMPARISON OF SEQUENCE GROUPS (continued)

PERCENT IDENTITY OF GROUP 11

|         | D58-AB9 | D56-AG9 | D56-AG6 | D35-BG11 | D35-42 | D35-BA3 | D34-57 | D34-52 | D34-25 |            |
|---------|---------|---------|---------|----------|--------|---------|--------|--------|--------|------------|
| D58-AB9 | ***     | 93.8    | 93.2    | 94.3     | 90.8   | 93.2    | 90.9   | 92.0   | 91.5   | SEQ ID No 47 |
| D56-AG9 |         | ***     | 96.6    | 97.2     | 94.2   | 96.6    | 91.5   | 92.6   | 92.0   | SEQ ID No 49 |
| D56-AG6 |         |         | ***     | 93.8     | 90.2   | 92.6    | 90.3   | 90.9   | 90.3   | SEQ ID No 51 |
| D35-BG11|         |         |         | ***      | 97.1   | 99.4    | 90.9   | 92.0   | 91.5   | SEQ ID No 53 |
| D35-42  |         |         |         |          | ***    | 96.5    | 87.3   | 88.4   | 87.9   | SEQ ID No 55 |
| D35-BA3 |         |         |         |          |        | ***     | 90.3   | 91.5   | 90.9   | SEQ ID No 57 |
| D34-57  |         |         |         |          |        |         | ***    | 98.9   | 98.3   | SEQ ID No 59 |
| D34-52  |         |         |         |          |        |         |        | ***    | 99.4   | SEQ ID No 61 |
| D34-25  |         |         |         |          |        |         |        |        | ***    | SEQ ID No 63 |

ALIGNMENT OF GROUP 14

D177-BD7    ATTAATTTTTCAATACCACTTGTTGAGCTTGCACTTGCTAATCTATTGTTTCATTATAAT    SEQ ID No 83

D177-BD5    ATTAATTTTTCAATACCACTTGTTGAGCTTGCACTTGCTAATCTATTGTTTCATTATAAT    SEQ ID No 69
            ************************************************************

D177-BD7    TGGTCACTTCCTGAGGGGATGCTACCTAAGGATGTTGATATGGAAGAAGCTTTGGGGATT

D177-BD5    TGGTCACTTCCTGAAGGGATGCTAGCTAAGGATGTTGATATGGAAGAAGCTTTGGGGATT
            ************ ***** *********************************

D177-BD7    ACCATGCACAAGAAATCTCCCCTTTGCTTAGTAGCTTCTCATTATAACTTGTTGTGA

D177-BD5    ACCATGCACAAGAAATCTCCCCTTTGCTTAGTAGCTTCTCATTATA-CTTGTTGA--
            ******************************************** *****

PERCENT IDENTITY OF GROUP 14

|         | D177-BD7 | D177-BD5 |              |
|---------|----------|----------|--------------|
| D177-BD7| ***      | 96.0     | SEQ ID No 83 |
| D177-BD5|          | ***      | SEQ ID No 69 |

ALIGNMENT OF GROUP 15

D56A-AG10   ATGCAACTTGGGCTTTATGCATTGGAAATGGCTGTGGCCCATCTTCTTCATTGTTTTACT    SEQ ID No 71

D58-AD12    ATGCAACTTGGGCTTTATGCATTGGAAATGGCTGTGGCCCATCTTCTTCATTGTTTTACT    SEQ ID No 75

D58-BC5     ATGCAACTTGGGCTTTATGCATTAGAAATGGCAGTGGCCCATCTTCTTCTTTGCTTTACT    SEQ ID No 73
            ********************* **** *********** * ******

D56A-AG10   TGGGAATTGCCAGATGGTATGAAACCAAGTGAGCTTAAAATGGATGATATTTTTGGACTC

D58-AD12    TGGGAATTGCCAGATGGTATGAAACCAAGTGAGCTTAAAATGGATGATATTTTTGGACTC

D58-BC5     TGGGAATTGCCAGATGGTATGAAACCAAGTGAGCTTAAAATGGATGATATTTTTGGACTC
            ************************************************************

D56A-AG10   ACTGCTCCAAAAGCTAATCGACTCGTGGCTGTGCCTACTCCACGTTTGTTGTGTCCCCTT

D58-AD12    ACTGCTCCAAGAGCTAATCGACTCGTGGCTGTGCCTACTCCACGTTTGTTGTGTCCCCTT

D58-BC5     ACTGCTCCAAGAGCTAATCGACTCGTGGCTGTGCCTAGTCCACGTTTGTTGTGCCCACTT
            ******** ********************* ************  ***

FIGURE 2: COMPARISON OF SEQUENCE GROUPS (continued)

```
D56A-AG10      TATTAA

D58-AD12       TATTAA

D58-BC5        TATTAA
               ******
```

PERCENT IDENTITY OF GROUP 15

|           | D56A-AG10 | D58-AD12 | D58-BC5 |              |
|-----------|-----------|----------|---------|--------------|
| D56A-AG10 | ***       | 99.5     | 95.7    | SEQ ID No 71 |
| D58-AD12  |           | ***      | 96.2    | SEQ ID No 75 |
| D58-BC5   |           |          | ***     | SEQ ID No 73 |

ALIGNMENT OF GROUP 16

```
D56-AD6        ATGCTTTGGAGTGCGAGTATAGTGCGCGTCAGCTACCTAACTTGTATTTATAGATTCCAA   SEQ ID No 87

D56-AC11       ATGCTTTGGAGTGCGAGTATAGTGCGCGTCAGCTACCTAACTTGTATTTATAGATTCCAA   SEQ ID No 77

D35-39         ATGCTTTGGAGTGCGAGTATAGTGCGCGTCAGCTACCTAACTTGTATTTATAGATTCCAA   SEQ ID No 79
                                                             |
D58-BH4        ATGCTTTGGAGTGCGAGTATAGTGCGCGTCAGCTACCTAACCTGTATTTATAGATTCCAA   SEQ ID No 81
               ****************************************  *******************

D56-AD6        GTATATGCTGGGTCTGTGTCCAGAGTAGCATGA
                                 |
D56-AC11       GTATATGCTGGGTCTGTGTTCAGAGTAGCATGAD35-39
GTATATGCTGGGTCTGTGTTCAGAGTAGCATGA

D58-BH4        GTATATGCTGGGTCTGTGTTCAGAGTAGCATGA
               ******************  *************
```

PERCENT IDENTITY OF GROUP 16

|          | D56-AC11 | D56-AD6 | D58-BH4 | D35-39 |              |
|----------|----------|---------|---------|--------|--------------|
| D56-AC11 | ***      | 98.7    | 98.7    | 98.7   | SEQ ID No 77 |
| D56-AD6  |          | ***     | 98.7    | 98.7   | SEQ ID No 87 |
| D58-BH4  |          |         | ***     | 98.7   | SEQ ID No 81 |
| D35-39   |          |         |         | ***    | SEQ ID No 79 |

ALIGNMENT OF GROUP 17

```
D73A-AD6       CTGAATTTTGCAATGTTAGAGGCAAAAATGGCACTTGCATTGATTCTACAACACTATGCT   SEQ ID No 89

D70A-BA11      CTGAATTTTGCAATGTTAGAGGCAAAAATGGCACTTGCATTGATTCTACAACACTATGCT   SEQ ID No 91
               ************************************************************

D73A-AD6       TTTGAGCTCTCTCCATCTTATGCACATGCTCCTCATACAATTATCACTCTGCAACCTCAA
                                         |
D70A-BA11      TTTGAGCTCTCTCCATCTTATGCACACGCTCCTCATACAATTATCACTCTGCAACCTCAA
               *************************  *********************************

D73A-AD6       CATGGTGCTCCTTTGATTTTGCGCAAGCTGTAG

D70A-BA11      CATGGTGCTCCTTTGATTTTGCGCAAGCTGTAG
               *********************************
```

FIGURE 2: COMPARISON OF SEQUENCE GROUPS (continued)

PERCENT IDENTITY OF GROUP 17

```
          D73A-AD  70A-BA11
D73A-AD6  ***      99.3       SEQ ID No 89
D70A-BA11          ***        SEQ ID No 91
```

ALIGNMENT OF GROUP 18

| | | |
|---|---|---|
| D70A-AB5 | CAAAACTTCGCGATTTTGGAAGCAAAAATGGCTATAGCTATGATTCTACAACGCTTCTCC | SEQ ID No 95 |
| D70A-AA8 | CAAAACTTCGCGATTTTGGAAGCAAAAATGGCTATAGCTATGATTCTACAACGCTTCTCC | SEQ ID No 97 |
| | ************************************************************ | |
| D70A-AB5 | TTCGAGCTCTCCCCATCTTATACACACTCTCCATACACTGTGGTCACTTTGAAACCCAAA | |
| |                             \| | |
| D70A-AA8 | TTCGAGCTCTCTCCATCTTATACACACTCTCCATACACTGTGGTCACTTTGAAACCCAAA | |
| | ****************************** ****************************** | |
| D70A-AB5 | TATGGTGCTCCCCTAATAATGCACAGGCTGTAG | |
| D70A-AA8 | TATGGTGCTCCCCTAATAATGCACAGGCTGTAG | |
| | ********************************* | |

PERCENT IDENTITY OF GROUP 18

```
          D70A-AB5   D70A-AA8
D70A-AB5  ***        99.6        SEQ ID No 95
D70A-AA8             ***         SEQ ID No 97
```

ALIGNMENT OF GROUP 19

| | | |
|---|---|---|
| D70A-AB8 | CAAAATTTTGCCATGTTAGAAGCAAAGATGGCTCTGTCTATGATCCTGCAACGCTTCTCT | SEQ ID No 99 |
| | \|\|   \|   \|   \|\|   \|   \|   \|   \|   \| | |
| D70A-BH2 | ATAAACTTTGCAATGACAGAAGCGAAGATGGCTATGGCTATGATTCTGCAACGCTTCTCC | SEQ ID No 101 |
| |          \| | |
| D70A-AA4 | ATAAACTTTGCAATGGCAGAAGCGAAGATGGCTATGGCTATGATTCTGCAACGCTTCTCC | SEQ ID No 103 |
| | *** ***** *** ****** **** ** ** ****** ** ********** | |
| D70A-AB8 | TTTGAACTGTCTCCGTCTTATGCACATGCCCCTCAGTCCATATTAACCGT-CAGCCACAA | |
| | \| \|   \|   \|   \| \| \|   \| \|   \|   \|\| \|   \| \| | |
| D70A-BH2 | TTTGAGCTATCTCCATCTTACACACATGCTCCACAGTCTGTAATAACTATGCAACCCCAA | |
| D70A-AA4 | TTTGAGCTATCTCCATCTTACACACATGCTCCACAGTCTGTAATAACTATGCAACCCCAA | |
| | ***** ** ***** ***** ******* ** ***** ** **** * ** ** ** | |
| D70A-AB8 | TATGGTGCTCCACTTATTTTCCACAAGCTATAA | |
| |         \|   \| \|   \|\|\| | |
| D70A-BH2 | TATGGTGCTCCTCTTATATTGCACAAATTGTAA | |
| D70A-AA4 | TATGGTGCTCCTCTTATATTGCACAAATTGTAA | |
| | *********** ***** ** ** ** * ** | |

PERCENT IDENTITY OF GROUP 19

```
          D70A-AB8   D70A-AA4   D70A-BH2
D70A-AB8  ***        77.8       77.8        SEQ ID No 99
D70A-AA4             ***        99.3        SEQ ID No 101
D70A-BH2                        ***         SEQ ID No 103
```

ALIGNMENT OF GROUP 20

D70A-BA1    CAAAACTTTGCAATGATGGAAGCAAAAATGGCAGTAGCTATGATACTACAAAAATTTTCC    SEQ ID No 105

FIGURE 2: COMPARISON OF SEQUENCE GROUPS
(continued)

```
D70A-BA9      CAAAACTTTGCAATGATGGAAGCAAAAATGGCAGTAGCTATGATACTACATAAATTTTCC    SEQ ID No 107
              ************************************************* ********

D70A-BA1      TTTGAACTATCCCCTTCTTATACACATGCTCCATTTGCAATTGTGACTATTCATCCTCAG

D70A-BA9      TTTGAACTATCCCCTTCTTATACACATGCTCCATTTGCAATTGTGACTATTCATCCTCAG
              ************************************************************

D70A-BA1      TATGGTGCTCCTCTGCTTATGCGCAGACTTTAA

D70A-BA9      TATGGTGCTCCTCTGCTTATGCGCAGACTTTAA
              *********************************
```

PERCENT IDENTITY OF GROUP 20

|          | D70A-BA1 | D70A-BA9 |              |
|----------|----------|----------|--------------|
| D70A-BA1 | ***      | 99.4     | SEQ ID No 105 |
| D70A-BA9 |          | ***      | SEQ ID No 107 |

ALIGNMENT OF GROUP 22

```
D144-AH1      TATAGCTTGGGGCTCAAGGAGATTCAAGCTAGCTTAGCTAATCTTCTACATGGATTTAAC    SEQ ID No 113
                  |                |
D34-65        CATAGCTTGGGGCTCAAGGTGATTCAAGCTAGCTTAGCTAATCTTCTACATGGATTTAAC    SEQ ID No 115
                  |   |            |
D181-AC5      TATAGCATGGGGCTCAAGGCGATTCAAGCTAGCTTAGCTAATCTTCTACATGGATTTAAC    SEQ ID No 111
              *****:*************  ***************************************

D144-AH1      TGGTCATTGCCTGATAATATGACTCCTGAGGACCTCAACATGGATGAGATTTTTGGGCTC

D34-65        TGGTCATTGCCTGATAATATGACTCCTGAGGACCTCAACATGGATGAGATTTTTGGGCTC

D181-AC5      TGGTCATTGCCTGATAATATGACTCCTGAGGACCTCAACATGGATGAGATTTTTGGGCTC
              ************************************************************

D144-AH1      TCTACACCTAAAAAATTTCCACTTGCTACTGTGATTGAGCCAAGACTTTCACCAAAACTT

D34-65        TCTACACCTAAAAAATTTCCACTTGCTACTGTGATTGAGCCAAGACTTTCACCAAAACTT

D181-AC5      TCTACACCTAAAAAATTTCCACTTGCTACTGTGATTGAGCCAAGACTTTCACCAAAACTT
              ************************************************************

D144-AH1      TACTCTGTTTGA

D34-65        TACTCTGTTTGA

D181-AC5      TACTCTGTTTGA
              ************
```

PERCENT IDENTITY OF GROUP 22

|          | D34-65 | D181-AC5 | D144-AH1 |              |
|----------|--------|----------|----------|--------------|
| D34-65   | ***    | 98.4     | 99.0     | SEQ ID No 115 |
| D181-AC5 |        | ***      | 99.0     | SEQ ID No 111 |
| D144-AH1 |        |          | ***      | SEQ ID No 113 |

ALIGNMENT OF GROUP 25

```
D58-AA1       TTGGGCTTGGCAACGGTGCATGTGAATTTGATGTTGGCCCGAATGATTCAAGAATTTGAA    SEQ ID No 121
                                                            |
D185-BC1      TTGGGCTTGGCAACGGTGCATGTGAATTTGATGTTGGCCCGAACGATTCAAGAATTTGAA    SEQ ID No 133
```

FIGURE 2: COMPARISON OF SEQUENCE GROUPS (continued)

```
D185-BG2         TTGGGCTTGGCAACGGTGCATGTGAATTTGATGTTGGCCCGAATGATTCAAGAATTTGAA    SEQ ID No 135
                 ********************************************  ****************

D58-AA1          TGGTCCGCTTACCCGGAAAATAGGAAAGTGGATTTTACTGAGAAATTGGAATTTACTGTG

D185-BC1         TGGTCCGCTTACCCGGAAAATAGGAAAGTGGATTTTACTGAGAAATTGGAATTTACTGTG

D185-BG2         TGGTCCGCTTACCCGGAAAATAGGAAAGTGGATTT-ACTGAGAAATTGGAATTTACTGTG
                 ***********************************  ***********************

D58-AA1          GTGATGAAAAATCCTTTAAGAGCTAAGGTCAAGCCAAGAATGCAAGTGGTGTAA

D185-BC1         GTGATGAAAAACCCTTTAAGAGCTAAGGTCAAGCCAAGAATGCAAGTGGTGTAA
                 |||||||||||  |||||||||||||||||||||||||||||||||||||||||
D185-BG2         GTGA--------------------------------------------------
                 ****
```

PERCENT IDENTITY OF GROUP 25

|         | D58-AA1 | D185-BG2 | D185-BC1 |              |
|---------|---------|----------|----------|--------------|
| D58-AA1 | ***     | 95.9     | 98.9     | SEQ ID No 121|
| D185-BG2|         | ***      | 95.1     | SEQ ID No 135|
| D185-BC1|         |          | ***      | SEQ ID No 133|

ALIGNMENT OF GROUP 28

```
D177-BF7         ATCACATTTGCTAAGTTTGTGAATGAGCTAGCATTGGCAAGATTAATGTTCCATTTTGAT    SEQ ID No 127

D185-BD2         ATCACATTTGCTAAGTTTGTGAATGAGCTAGCATTGGCAAGATTAATGTTCCATTTTGAT    SEQ ID No 139

D185-BE1         ATCACATTTGCTAAGTTTGTGAATGAGCTAGCATTGGCAAGATTAATGTTCCATTTTGAT    SEQ ID No 137
                 ************************************************************

D177-BF7         TTCTCGCTACCAAAAGGAGTTAAGCATGAGGATTTGGACGTGGAGGAAGCTGCTGGAATT

D185-BD2         TTCTCGCTACCAAAAGGAGTTAAGCATGCGGATTTGGACGTGGAGGAAGCTGCTGGAATT

D185-BE1         TTCTCGCTACCAAAAGGAGTTAAGCATGAGGATTTGGACGTGGAGGAAGCTGCTGGAATT
                 ****************************  ******************************

D177-BF7         ACTGTTAGAAGGAAGTTCCCCCTTTTAGCCGTCGCCACTCCATGCTCGTGA

D185-BD2         ACTGTTAGAAGGAAGTTCCCCCTTTTAGCCGTCGCCACTCCATGCTCGTGA

D185-BE1         ACTGTTAGGAGGAAGTTCCCCCTTTTAGCCGTCGCCACTCCATGCTCGTGA
                 ******** ******************************************
```

PERCENT IDENTITY OF GROUP 28

|         | D177-BF7 | D185-BD2 | D185-BE1 |              |
|---------|----------|----------|----------|--------------|
| D177-BF7| ***      | 99.4     | 99.4     | SEQ ID No 127|
| D185-BD2|          | ***      | 98.8     | SEQ ID No 139|
| D185-BE1|          |          | ***      | SEQ ID No 137|

ALIGNMENT OF GROUP 30

```
D70A-AA12        ATGTCATTTGGTTTAGCTAATCTTTACTTACCATTGGCTCAATTACTCTATCACTTTGAC    SEQ ID No 131
                    | ||||||||||  |||||||  |  |  ||  ||||||| ||  ||  |  ||||||||
D176-BF2         ATATCATTTGGTTTGGCTAATGTTTATTTGCCACTAGCTCAATTGTTATATCATTTTGAT    SEQ ID No 85
```

FIGURE 2: COMPARISON OF SEQUENCE GROUPS (continued)

```
              ** *********** ****** **** ** *** * ********  * ***** *****

D70A-AA12     TGGAAACTCCCAACCGGAATCAAGCCAAGAGACTTGGACTTGACCGAATTATCGGGAATA
               |  |          ||    |           |    |  | || |   |
D176-BF2      TGGAAACTCCCTACTGGAATCAATTCAAGTGACTTGGACATGACTGAGTCGTCAGGAGTA
              *********** ** ********  **** ********* **** ** *  ** *** **

D70A-AA12     ACTATTGCTAGAAAGGGTGACCTTTACTTAAATGCTACTCCTTATCAACCTTCTCGAGAGTAA
                ||           |   ||| |   | |           |        |      |
D176-BF2      ACTTGTGCTAGAAAGAGTGATTTATACTTGACTGCTACTCCATATCAACTTTCTCAAGAGTGA
              *** ********** ****  *  ***** * ********* ******* ***** ***** *
```

PERCENT IDENTITY OF GROUP 30

|          | D176-BF2 | D70A-AA12 |              |
|----------|----------|-----------|--------------|
| D176-BF2 | ***      | 77.0      | SEQ ID No 85 |
| D70A-AA12 |         | ***       | SEQ ID No 131 |

FIGURE 3A: Alignment of Full Length Clones

```
GROUP 1          RxxRxxP         FxPERP                    Gx RxC
D208-AD9    EVLRLYPPGP LLVPHENVED CVVSGYHIPK GTRLFANVMK LQRDPKLWSD PDTFDPERFI ATDIDFRGQY YKYIPFGPGR RSC SEQ. ID. NO. 297
98.8
D120-AH4    EVLRLYPPGP LLVPHENVED CVVSGYHIPK GTRLFANVMK LLRDPKLWPD PDTFDPERFI ATDIDFRGQY YKYIPFGSGR RSC SEQ. ID. NO. 298
97.6
D121-AA8    EVLRLYPPGP LLVPHENVED CVVSGYHIPK GTRLFANVMK LQRDPKLWSD PDTFDPERFI ATDIDFRGQY YKYIPFGSGR RSC SEQ. ID. NO. 299
91.6
D122-AF10   EVLRLYPPGP LLVPHENVED CVVSGYHIPK GTRLFANVMK LQRDPKLWSN PDKFDPERFF ADDIDYRGQH YEFIPFGSGR RSC SEQ. ID. NO. 300
91.6
D103-AH3    KVLRLYPPGP LLVPHENVKD CVVSGYHIPK GTRLFANVMK LQRDPKLLSN PDKFDPERFI AGDIDFRGHH YEFIPSGSGR RSC SEQ. ID. NO. 301
98.8
D208-AC8    KVLRLYPPGP LLVPHENVKD CVVSGYHIPK GTRLFANVMK LQRDPKLLSN PDKFDPERFI AGDIDFRGHH YEFIPFGSGR RSC SEQ. ID. NO. 302
98.8
D235-AB1    KVLRLYPPGP LLVPHEYVKD CVVSGYHIPK GTRLFANVMK LQRDPKLLSN PDKFDPERFI AGDIDFRGHH YEFIPFGSGR RSC SEQ. ID. NO. 303

GROUP 2          RxxRxxP         FxPERP                    GxRxC
D244-AD4    ETLRLYPPVP FLLPHEAVQD CKVTGYHIPK GTRLYINAWK VHRDPEIWSE PEKFMPNRFL TSKANIDARG QNFEFIPFGS GRRSC SEQ. ID. NO. 304
100.0
D244-AB6    ETLRLYPPVP FLLPHEAVQD CKVTGYHIPK GTRLYINAWK VHRDPEIWSE PEKFMPNRFL TSKANIDARG QNFEFIPFGS GRRSC SEQ. ID. NO. 305
98.8
D285-AA8    ETLRLFPPVP FLLPHEAVQD CKVTGYHIPK GTRLYINAWK VHRDPEIWSE PEKFMPNRFL TSKANIDARG QNFEFIPFGS GRRSC SEQ. ID. NO. 306
100.0
D285-AB9    ETLRLFPPVP FLLPHEAVQD CKVTGYHIPK GTRLYINAWK VHRDPEIWSE PEKFMPNRFL TSKANIDARG QNFEFIPFGS GRRSC SEQ. ID. NO. 307
97.6
D268-AE2    ETLRLYPPVP FLLPHEAVQD CKVTGYHIPK GTRLYINAWK VHRDSEIWSE PEKFMPNRFL TSKANIDARG QNFEFIPFGS GRRSC SEQ. ID. NO. 308

GROUP 3          RxxRxxP         FxPERP                    GxRx C
D100A-AC3   ETFRMYPAGP LLVPHESSEE TTVGGYRVPG GTMLLVNLWA IHNDPKLWDE PRKFKPERFE GLEGVRDGYK MMPFGSGRRS C SEQ. ID. NO. 309
97.6
D100A-BE2   ETFRMYPAGP LLVPHESSEE TTVGGYRVPG GTMLLVNLWA IHNDPKLWDE PRKFKPERFQ GLDGVRDGYK MMPFGSGRRS C SEQ. ID. NO. 310
```

FIGURE 3B: Alignment of Full Length Clones

```
                       ExxRxxP                            FxPERF                           Gx RxC
GROUP 4
D205-BG9       ETMRLYTPIP LLLPHYSTKD CIVEGYDVPK HTMLFVNAWA IHRDPKVWEE PDKFKPERFE ATEGETERFN YKLVPFGMGR RAC  SEQ. ID. NO. 311
  100.0
D205-BE9       ETMRLYTPIP LLLPHYSTKD CIVEGYDVPK HTMLFVNAWA IHRDPKVWEE PDKFKPERFE ATEGETERFN YKLVPFGMGR RAC  SEQ. ID. NO. 312
  100.0
D205-AH4       ETMRLYTPIP LLLPHYSTKD CIVEGYDVPK HTMLFVNAWA IHRDPKVWEE PDKFKPERFE ATEGETERFN YKLVPFGMGR RAC  SEQ. ID. NO. 313

ExxRxxP                            FxPERF                           Gx RxC
GROUP 5
D259-AB9       ETMRLHPVAP MLVPRECRED IKVAGYDVQK GTRVLVSVWT IGRDPTLWDE PEVFKPERFH EKSIDVKGHD YELLPFGAGR RMC  SEQ. ID. NO. 314
  100.0
D257-AE4       ETMRLHPVAP MLVPRECRED IKVAGYDVQK GTRVLVSVWT IGRDPTLWDE PEVFKPERFH EKSIDVKGHD YELLPFGAGR RMC  SEQ. ID. NO. 315
  98.8
D147-AD3       ETMRLHPVAP MLVPRECRED IKVAGYDVQK GTRVLVSVWT IGRDPTLWDE PEVFKPERFH ERSIDVKGHD YELLPFGAGR RMC  SEQ. ID. NO. 316

ExxRxxP                            FxPERF                           Gx RxC
GROUP 6
D249-AEB       EALRLHPPTP LMLPHRASAS VKIGGYDIPK GSIVHVNVWA VARDPAVWKN PLEFRPERFL EEDVDMKGHD YRLLPFGAGR RVC  SEQ. ID. NO. 317
  98.8
D248-AA6       EALRLHPPTP LMLPHKASAS VKIGGYDIPK GSIVHVNVWA VARDPAVWKN PLBFRPERFL EEDVDMKGHD YRLLPFGAGR RVC  SEQ. ID. NO. 318

ExxRxxP                            FxPERF                           Gx RxC
GROUP 7
D233-AG7       ETLRLHPLGT MLAPHCAIED CNVAGYDIQK GTTFLVNVWT IGRDPKYWDR AQEFLPERFL ENDIDMDGHN FAFLPFGSGR RRC  SEQ. ID. NO. 319
  98.8
D224-BD11      ETLRLHPLGT MLAPHCAIED CNVAGYDIQK GTTVLVNVWT IGRDPKYWDR AQEFLPERFL ENDIDMDGHN FAFLPFGSGR RRC  SEQ. ID. NO. 320
  100.0
D224-AF10      ETLRLHPLGT MLAPHCAIED CNVAGYDIQK GTTVLVNVWT IGRDPKYWDR AQEFLPERFL ENDIDMDGHN FAFLPFGSGR RRC  SEQ. ID. NO. 321

ExxRxxP                            FxPERF                           Gx RxC
GROUP 8
D105-AD6       EVLRLYPAGY VINRMVNKET KLGNLCLPAG VQLVLPTMLL QHDTEIWGDD AMEFNPERFS DGISKATKGK LVFPPFSWGP RIC  SEQ. ID. NO. 322
  100.0
D215-AB5       EVLRLYPAGY VINRMVNKET KLGNLCLPAG VQLVLPTMLL QHDTEIWGDD AMEFNPERFS DGISKATKGK LVFPPFSWGP RIC  SEQ. ID. NO. 323
  95.2
D135-AB1       EVLRLYPAGY AINRMVTKET KLGNLCLPAG VQLLLPTILL QHDTEIWGDD AMEFNPERFS DGISKATKGK LVFPPFSWGP RIC  SEQ. ID. NO. 324
```

FIGURE 3C: Alignment of Full Length Clones

```
                      ExxRxxP        FxPERF                                        Gx  RxC
GROUP 9
D87A-AF3    ESLRLYPPIA TRTRRTNEET KLGELDLPKG ALLFIPTILL HLDKEIWGED PESFMPERFS EGVAKATKGK MTYPFFGAGP RKC SEQ. ID. NO. 325
 100.0
D210-BD4    ESLRLYPPIA TRTRRTNEET KLGELDLPKG ALLFIPTILL HLDREIWGED ADEFNPERFS EGVAKATKGK MTYPFFGAGP RKC SEQ. ID. NO. 326

ExxRxxP        FxPERF                                        Gx  RxC
GROUP 10
D89-AB1     ETLRMHPPIP LLVPRECMED TKIDGYNIPF KTRVIVNAWA IGRDPESWDD PESFMPERFE NSSIDFLGNH HQFIPFGAGR RIC SEQ. ID. NO. 327
 100.0
D89-AD2     ETLRMHPPIP LLVPRECMED TKIDGYNIPF KTRVIVNAWA IGRDPESWDD PESFMPERFE NSSIDFLGNH HQFIPFGAGR RIC SEQ. ID. NO. 328
 100.0
D163-AG12   ETLRMHPPIP LLVPRECMED TKIDGYNIPF KTRVIVNAWA IGRDPESWDD PESFMPERFE NNSIDFLGNH HQFIPFGAGR RIC SEQ. ID. NO. 329
  98.8
D163-AG11   ETLRMHPPIP LLVPRECMED TKIDGYNIPF KTRVIVNAWA IGRDPQSWDD PESFTPERFE NNSIDFLGNH HQFIPFGAGR RIC SEQ. ID. NO. 330
 100.0
D163-AF12   ETLRMHPPIP LLVPRECMED TKIDGYNIPF KTRVIVNAWA IGRDPQSWDD PESFTPERFE NNSIDFLGNH HQFIPFGAGR RIC SEQ. ID. NO. 331

ExxRxxP        FxPERF                                        Gx  RxC
GROUP 11
D267-AF10   ETLRMHPPVP LLGPRECRDQ TEIDGYTVPI KARVMVNAWA IGRDPESWED PESFKPERFE NTSVDLTGNH YQFIPFGSGR RMC SEQ. ID. NO. 332
 100.0
D96-AC2     ETLRMHPPVP LLGPRECRDQ TEIDGYTVPI KARVMVNAWA IGRDPESWED PESFKPERFE NTSVDLTGNH YQFIPFGSGR RMC SEQ. ID. NO. 333
 100.0
D96-AB6     ETLRMHPPVP LLGPRECRDQ TEIDGYTVPI KARVMVNAWA IGRDPESWED PESFKPERFE NTSVDLTGNH YQFIPFGSGR RMC SEQ. ID. NO. 334
  96.4
D207-AA5    ETLRMHPPVP LLGPRECREQ TEIDGYTVPL KARVMVNAWA IGRDPESWED PESFKPERFE NISVDLTGNH YQFIPFGSGR RMC SEQ. ID. NO. 335
 100.0
D207-AB4    ETLRMHPPVP LLGPRECREQ TEIDGYTVPL KARVMVNAWA IGRDPESWED PESFKPERFE NISVDLTGNH YQFIPFGSGR RMC SEQ. ID. NO. 336
 100.0
D207-AC4    ETLRMHPPVP LLGPRECREQ TEIDGYTVPL KARVMVNAWA IGRDPESWED PESFKPERFE NISVDLTGNH YQFIPFGSGR RMC SEQ. ID. NO. 337

ExxRxxP        FxPERF                                        Gx  RxC
GROUP 12
D98-AG1     ETLRLHPPTP LLVPRECREE TEIEGFTIPL KSKVLVNVWA IGRDPENWKN PECFIPERFE NSSIEFTGNH FQLLPFGAGR RIC SEQ. ID. NO. 338
 100.0
D98-AA1     ETLRLHPPTP LLVPRECREE TEIEGFTIPL KSKVLVNVWA IGRDPENWKN PECFIPERFE NSSIEFTGNH FQLLPFGAGR RIC SEQ. ID. NO. 339
```

FIGURE 3D: Alignment of Full Length Clones

| | ExxRxxP | | | | FxPERF | | Gx RxC | |
|---|---|---|---|---|---|---|---|---|
| GROUP 13 | | | | | | | | |
| D209-AA10 100.0 | ETLRLHPPVP | LLLPRECREE | TNINGYTIPV | KTKVMVNVWA | LGRDPKYWND | AETFMPERFE | QCSKDFVGNN | FEYLPFGGGR RIC SEQ. ID. NO. 340 |
| D209-AA12 100.0 | ETLRLHPPVP | LLLPRECREE | TNINGYTIPV | KTKVMVNVWA | LGRDPKYWND | AETFMPERFE | QCSKDFVGNN | FEYLPFGGGR RIC SEQ. ID. NO. 341 |
| D209-AH10 100.0 | ETLRLHPPVP | LLLPRECREE | TNINGYTIPV | KTKVMVNVWA | LGRDPKYWND | AETFMPERFE | QCSKDFVGNN | FEYLPFGGGR RIC SEQ. ID. NO. 342 |
| D209-AH12 97.6 | ETLRLHPPVP | LLLPRECREE | TNINGYTIPV | KTKVMVNVWA | LGRDPKYWND | AETFMPERFE | QCSKDFVGNN | FEYLPFGGGR RIC SEQ. ID. NO. 343 |
| D90a-BB3 | ETLRLHPPVP | LLLPRECREE | TNINGYTIPV | KTKVMVNVWA | LGRDPKYWDD | AETFKPERFE | QCSKDFVGNN | PEYLPFGGGR RIC SEQ. ID. NO. 344 |
| | ExxRxxP | | | | FxPERF | | Gx RxC | |
| GROUP 14 | | | | | | | | |
| D129-AD10 100.0 | ETLRLHPPIP | LLLHETAEES | TVSGYHIPAK | SHVIINSFAI | GRDKNSWEDP | ETYKPSRFLK | EGVPDFKGGN | FEFIPFGSGR RSC SEQ. ID. NO. 345 |
| D104A-AE8 | ETLRLHPPIP | LLLHETAEES | TVSGYHIPAK | SHVIINSFAI | GRDKNSWEDP | ETYKPSRFLK | EGVPDFKGGN | FEFIPFGSGR RSC SEQ. ID. NO. 346 |
| | ExxRxxP | | | | FxPERF | | Gx RxC | |
| GROUP 15 | | | | | | | | |
| D228-AH8 100.0 | EIFRLYPPAP | LLVPRESMEK | TILEGYEIRP | RTIVHVNAWA | IARDPEIWEN | PDEFIPERFL | NSSIDYKGQD | FELLPFGAGR RGC SEQ. ID. NO. 347 |
| D228-AD7 100.0 | EIFRLYPPAP | LLVPRESMEK | TILEGYEIRP | RTIVHVNAWA | IARDPEIWEN | PDEFIPERFL | NSSIDYKGQD | FELLPFGAGR RGC SEQ. ID. NO. 348 |
| D250-AC11 100.0 | EIFRLYPPAP | LLVPRESMEK | TILEGYBIRP | RTIVHVNAWA | IARDPEIWEN | PDEFIPERFL | NSSIDYKGQD | FELLPFGAGR RGC SEQ. ID. NO. 349 |
| D247-AH1 | EIFRLYPPAP | LLVPRESMEK | TILEGYEIRP | RTIVHVNAWA | IARDPEIWEN | PDEFIPERFL | NSSTDYKGQD | FELLPFGAGR RGC SEQ. ID. NO. 350 |
| | ExxRxxP | | | | FxPERF | | GxRxC | |
| GROUP 16 | | | | | | | | |
| D128-AB7 98.8 | EALRLRMAIP | LLVPHMNLHD | AKLGGFDIPA | ESKILVNAWW | LANNPAHWKK | PEEFRPERFF | EEEKHVEANG | NDFRYLPFGV GRRSC SEQ. ID. NO. 3 |
| D243-AA2 97.7 | EALRLRMAIP | LLVPHMNLHD | AKLGGLDIPA | ESKILVNAWW | LANNPAHWKK | PEEFRPERFF | EEEKHVEANG | NDFRYLPFGV GRRSC SEQ. ID. NO. 3 |
| D125-AF11 | ETLRLRMAIP | LLVPHMNLHD | AKLGGFDIPA | ESKILVNAWW | LANNPAHWKK | PEEFRPERFF | EEEKHVEANG | NDFRYLPFGV GRRSC SEQ. ID. NO. 3 |

FIGURE 3E: Alignment of Full Length Clones

GROUP 17

```
                ExcRxxP          FxPERF                    Gx RxC
D284-AH5    ESLRLYSPVV SLIRRPNEDA ILGNVSLPEG VLLSLPVILL HHDEEIWGKD -KKFNPERFR DGVSSATKGQ VTFFPFTWGP RIC  SEQ. ID. NO. 354
86.7
D110-AF12   ESLRLYPPVV TLTRRPKEDT VLGDVSLPAG VLISLPVILL HHDEEIWGKD AKKFKPERFR DGVSSATKGQ VTFFPFTWGP RIC  SEQ. ID. NO. 355
```

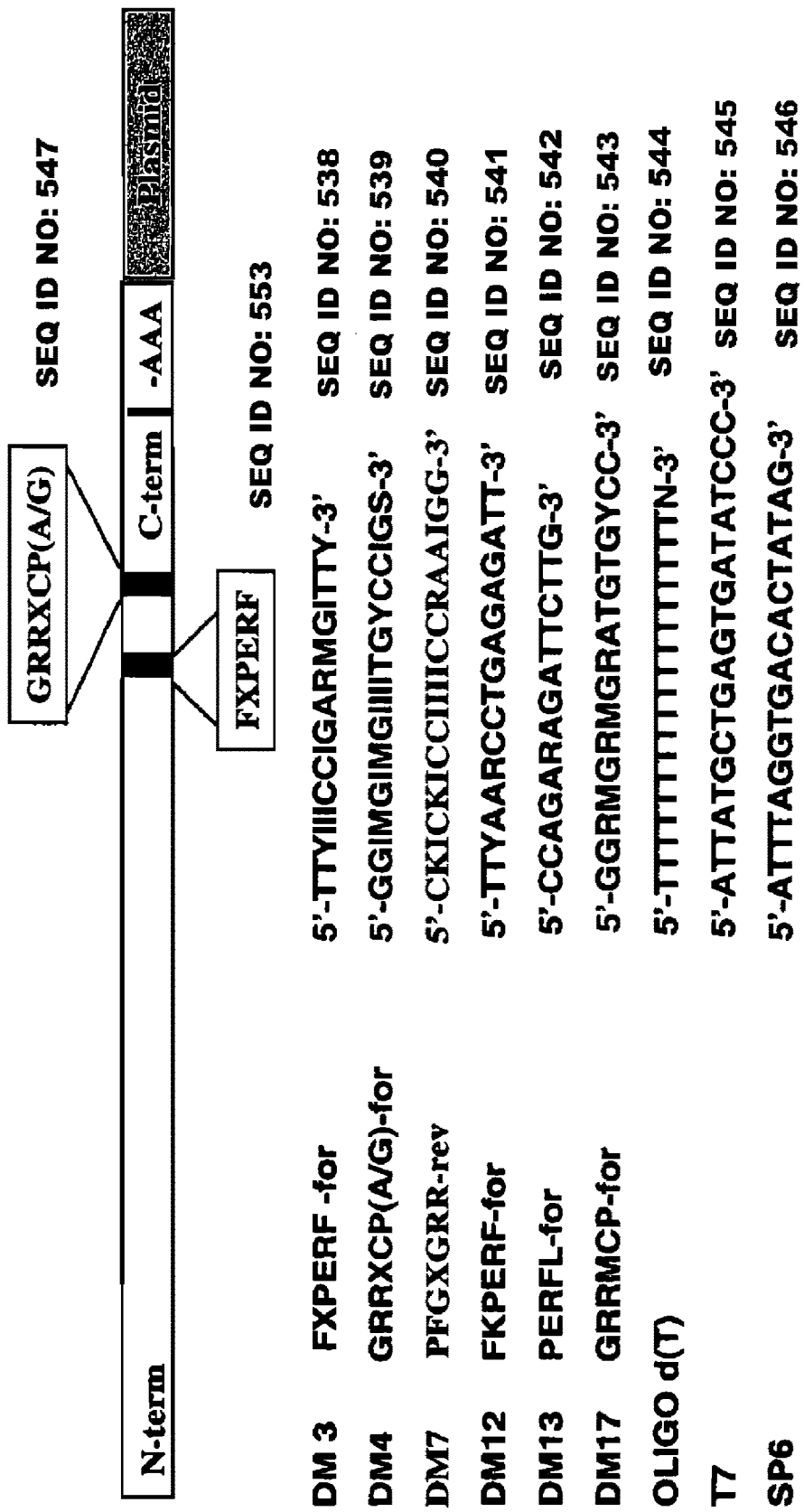
Figure 4: Cloning of cytochrome P450 cDNA fragments by PCR

Figure 5

Probe set sequences of all clones on GeneChip Array

| Probe Set Name | Probe Set Name | Probe X | Probe Y | Probe Interrogation Position | Probe Sequence | SEQ ID |
|---|---|---|---|---|---|---|
| GEN1018_x_at | D120-AH4 | 7 | 65 | 14 | GAAAGCGTTTAAGGATTTTATGATT | 374 |
| GEN1018_x_at | D120-AH4 | 110 | 91 | 35 | GATTTTATCAATGGAGTTTGTGTTA | 375 |
| GEN1018_x_at | D120-AH4 | 65 | 115 | 57 | TTATGGATGCATTTCCAATTCCAT | 376 |
| GEN1018_x_at | D120-AH4 | 52 | 111 | 60 | TGGGATGCATTTCCAATTCCATTAT | 377 |
| GEN1018_x_at | D120-AH4 | 18 | 97 | 62 | GGATGCATTTCCAATTCCATTATTT | 378 |
| GEN1018_x_at | D120-AH4 | 38 | 85 | 63 | GATGCATTTCCAATTCCATTATTTA | 379 |
| GEN1018_x_at | D120-AH4 | 99 | 117 | 65 | TGCATTTCCAATTCCATTATTTAAA | 380 |
| GEN1018_x_at | D120-AH4 | 18 | 69 | 66 | GCATTTCCAATTCCATTATTTAAAT | 381 |
| GEN1018_x_at | D120-AH4 | 59 | 3 | 82 | TATTTAAATGGGTGGATTTTCAAGG | 382 |
| GEN1018_x_at | D120-AH4 | 13 | 23 | 97 | ATTTTCAAGGCATGTTAAGGCTAT | 383 |
| GEN1018_x_at | D120-AH4 | 28 | 53 | 102 | CAAGGGCATGTTAAGGCTATGAAAA | 384 |
| GEN1018_x_at | D120-AH4 | 10 | 93 | 106 | GGCATGTTAAGGCTATGAAAAGGAC | 385 |
| GEN1018_x_at | D120-AH4 | 44 | 79 | 110 | TGTTAAGGCTATGAAAAGGACTTTT | 386 |
| GEN1018_x_at | D120-AH4 | 95 | 47 | 274 | AAGGTTACTCTCGTGATACTGTCAT | 387 |
| GEN1018_x_at | D120-AH4 | 1 | 73 | 333 | GCAGACACAGTTGCTCTTCACATAA | 388 |
| GEN1018_x_at | D120-AH4 | 63 | 41 | 339 | ACAGTTGCTCTTCACATAAATTGGG | 389 |
| GEN1018_x_at | D120-AH4 | 84 | 81 | 473 | GGTATACCTCCAAGCTATTGTTAAA | 390 |
| GEN1018_x_at | D120-AH4 | 25 | 95 | 501 | GTGTTACGATTATATCCACCAGGAC | 391 |
| GEN1018_x_at | D120-AH4 | 89 | 21 | 505 | TACGATTATATCCACCAGGACCTTT | 392 |
| GEN1018_x_at | D120-AH4 | 87 | 3 | 519 | CCAGGACCTTTGTTAGTACCACACG | 393 |
| GEN1018_x_at | D120-AH4 | 30 | 3 | 525 | CCTTTGTTAGTACCACACGAAAATG | 394 |
| GEN1018_x_at | D120-AH4 | 1 | 107 | 622 | TACGTGATCCTAAACTCTGCCTGA | 395 |
| GEN1018_x_at | D120-AH4 | 72 | 19 | 643 | CTGATCCTGATACTTTCGATCCAGA | 396 |
| GEN1018_x_at | D120-AH4 | 33 | 55 | 690 | GACTTTCGTGGTCAGTACTATAAGT | 397 |
| GEN1018_x_at | D120-AH4 | 103 | 103 | 698 | TGGTCAGTACTATAAGTATATCCCG | 398 |
| GEN1019_x_at | D121-AA8 | 107 | 73 | 13 | GAATTGAATTTTGGTCTGATCGTGA | 399 |
| GEN1019_x_at | D121-AA8 | 65 | 107 | 24 | TGGTCTGATCGTGAAGATGATCGCT | 400 |
| GEN1019_x_at | D121-AA8 | 119 | 25 | 31 | ATCGTGAAGATGATCGCTGAAAAA | 401 |
| GEN1019_x_at | D121-AA8 | 72 | 71 | 39 | GATGATCGCTGAAAAAATTATGAA | 402 |

Figure 5 (continued)

Probe set sequences of all clones on GeneChip Array

| Probe Set Name | | Probe X | Probe Y | Probe Interrogation Position | Probe Sequence | SEQ ID |
|---|---|---|---|---|---|---|
| GEN1019_x_at | D121-AA8 | 107 | 105 | 58 | TATGAATCCGGTAAAGGAGATGAAC | 403 |
| GEN1019_x_at | D121-AA8 | 69 | 1 | 64 | TCCGGTAAAGGAGATGAACAAGTGG | 404 |
| GEN1019_x_at | D121-AA8 | 1 | 15 | 80 | AACAAGTGGAGAGATTTAAGAAAGC | 405 |
| GEN1019_x_at | D121-AA8 | 111 | 91 | 120 | GATTTTATCAATGGAGTTTGTGTTA | 406 |
| GEN1019_x_at | D121-AA8 | 63 | 115 | 142 | TTATGGGATGCATTTCCAATTCCAT | 407 |
| GEN1019_x_at | D121-AA8 | 54 | 111 | 145 | TGGGATGCATTTCCAATTCCATTAT | 408 |
| GEN1019_x_at | D121-AA8 | 14 | 97 | 147 | GGATGCATTTCCAATTCCATTATTT | 409 |
| GEN1019_x_at | D121-AA8 | 35 | 85 | 148 | GATGCATTTCCAATTCCATTATTTA | 410 |
| GEN1019_x_at | D121-AA8 | 98 | 117 | 150 | TGCATTTCCAATTCCATTATTTAAA | 411 |
| GEN1019_x_at | D121-AA8 | 96 | 59 | 164 | CATTATTTAAATGGGTGGATTTTCA | 412 |
| GEN1019_x_at | D121-AA8 | 12 | 23 | 182 | ATTTTCAAGGGCATGTTAAGGCTAT | 413 |
| GEN1019_x_at | D121-AA8 | 27 | 53 | 187 | CAAGGGCATGTTAAGGCTATGAAAA | 414 |
| GEN1019_x_at | D121-AA8 | 45 | 79 | 195 | TGTTAAGGCTATGAAAAGGACTTTT | 415 |
| GEN1019_x_at | D121-AA8 | 94 | 47 | 359 | AAGGTTACTCTCGTGATACTGTCAT | 416 |
| GEN1019_x_at | D121-AA8 | 2 | 73 | 418 | GCAGACACAGTTGCTCTTCACATAA | 417 |
| GEN1019_x_at | D121-AA8 | 74 | 83 | 588 | GTTACGATTATATCCACCAGGACCT | 418 |
| GEN1019_x_at | D121-AA8 | 88 | 3 | 604 | CCAGGACCTTGTTGTTAGTACCACACG | 419 |
| GEN1019_x_at | D121-AA8 | 31 | 3 | 610 | CCTTTGTTAGTACCACACGAAAATG | 420 |
| GEN1019_x_at | D121-AA8 | 111 | 11 | 719 | AACTCTGGTCTGATCCTGATACTTT | 421 |
| GEN1019_x_at | D121-AA8 | 32 | 55 | 775 | GACTTTCGTGGTCAGTACTATAAGT | 422 |
| GEN1019_x_at | D121-AA8 | 102 | 103 | 783 | TGGTCAGTACTATAAGTATATCCCG | 423 |
| GEN1019_x_at | D35-BG11 | 32 | 7 | 58 | GATCCAAGGTTTCAATTACAGAACT | 424 |
| GEN2012_x_at | D35-BG11 | 119 | 101 | 114 | GTGCAGGCATAACTATACGTAAGGT | 425 |
| GEN2012_x_at | D35-BG11 | 21 | 27 | 140 | AATCCTGTGGAACTGATAATAGCGC | 426 |
| GEN2012_x_at | D35-BG11 | 66 | 21 | 141 | ATCCTGTGGAACTGATAATAGCGCC | 427 |
| GEN2012_x_at | D35-BG11 | 108 | 17 | 143 | CCTGTGGAACTGATAATAGCGCCTC | 428 |
| GEN2012_x_at | D35-BG11 | 71 | 105 | 145 | TGTGGAACTGATAATAGCGCCTCGC | 429 |
| GEN2012_x_at | D35-BG11 | 64 | 99 | 148 | GGAACTGATAATAGCGCCTCGCCTG | 430 |
| GEN2012_x_at | D35-BG11 | 14 | 77 | 149 | GAACTGATAATAGCGCCTCGCCTGG | 431 |

Figure 5 (continued)

Probe set sequences of all clones on GeneChip Array

| Probe Set Name | Probe X | Probe Y | Probe Interrogation Position | Probe Sequence | SEQ ID |
|---|---|---|---|---|---|
| GEN2012_x_at | D35-BG11 | 119 | 33 | 151 | ACTGATAATAGCGCCTCGCCTGGCA | 432 |
| GEN2012_x_at | D35-BG11 | 17 | 109 | 166 | TCGCCTGGCACCTGAGCTTTATTAA | 433 |
| GEN2012_x_at | D35-BG11 | 58 | 55 | 170 | CTGGCACCTGAGCTTTATTAAAACC | 537 |

US 8,058,504 B2

CLONING OF CYTOCHROME P450 GENES FROM *NICOTIANA*

CROSS-REFERENCE TO RELATED APPLICATIONS

This application claims the benefit of U.S. Provisional Application No. 60/503,989, filed Sep. 18, 2003, U.S. Provisional Application No. 60/485,368, filed Jul. 8, 2003, and U.S. Provisional Application No. 60/418,933, filed Oct. 16, 2002.

This application is also a divisional of U.S. patent application Ser. No. 10/943,507, filed Sep. 17, 2004, now U.S. Pat. No. 7,855,318 which is a continuation-in-part of U.S. application Ser. No. 10/686,947, filed Oct. 16, 2003, now abandoned which is a continuation-in-part of U.S. application Ser. No. 10/387,346, filed Mar. 12, 2003, now abandoned which is a continuation-in-part of U.S. application Ser. No. 10/340,861, filed Jan. 10, 2003, now abandoned which is a continuation-in-part of U.S. application Ser. No. 10/293,252, filed Nov. 13, 2002, now abandoned which claims the benefit of U.S. Provisional Application No. 60/363,684, filed Mar. 12, 2002, U.S. Provisional Application No. 60/347,444, filed Jan. 11, 2002, and U.S. Provisional Application No. 60/337,684, filed on Nov. 13, 2001.

The present invention relates to nucleic acid sequences encoding cytochrome p450 enzymes (hereinafter referred to as p450 and p450 enzymes) in *Nicotiana* plants and methods for using those nucleic acid sequences to alter plant phenotypes.

BACKGROUND

Cytochrome p450s catalyze enzymatic reactions for a diverse range of chemically dissimilar substrates that include the oxidative, peroxidative and reductive metabolism of endogenous and xenobiotic substrates. In plants, p450s participate in biochemical pathways that include the synthesis of plant products such as phenylpropanoids, alkaloids, terpenoids, lipids, cyanogenic glycosides, and glucosinolates (Chappel, Annu. Rev. Plant Physiol. Plant Mol. Biol. 198, 49:311-343). Cytochrome p450s, also known as p450 hemethiolate proteins, usually act as terminal oxidases in multicomponent electron transfer chains, called p450-containing monooxygenase systems. Specific reactions catalyzed include demethylation, hydroxylation, epoxidation, N-oxidation, sulfooxidation, N-, S-, and O-dealkylations, desulfation, deamination, and reduction of azo, nitro, and N-oxide groups.

The diverse role of *Nicotiana* plant p450 enzymes has been implicated in effecting a variety of plant metabolites such as phenylpropanoids, alkaloids, terpenoids, lipids, cyanogenic glycosides, glucosinolates and a host of other chemical entities. During recent years, it is becoming apparent that some p450 enzymes can impact the composition of plant metabolites in plants. For example, it has been long desired to improve the flavor and aroma of certain plants by altering its profile of selected fatty acids through breeding; however very little is known about mechanisms involved in controlling the levels of these leaf constituents. The down regulation of p450 enzymes associated with the modification of fatty acids may facilitate accumulation of desired fatty acids that provide more preferred leaf phenotypic qualities. The function of p450 enzymes and their broadening roles in plant constituents is still being discovered. For instance, a special class of p450 enzymes was found to catalyze the breakdown of fatty acid into volatile C6- and C9-aldehydes and -alcohols that are major contributors of "fresh green" odor of fruits and vegetables. The level of other novel targeted p450s may be altered to enhance the qualities of leaf constituents by modifying lipid composition and related break down metabolites in *Nicotiana* leaf. Several of these constituents in leaf are affected by senescence that stimulates the maturation of leaf quality properties. Still other reports have shown that p450s enzymes are play a functional role in altering fatty acids that are involved in plant-pathogen interactions and disease resistance.

In other instances, p450 enzymes have been suggested to be involved in alkaloid biosynthesis. Nornicotine is a minor alkaloid found in *Nicotiana tabaceum*. It has been postulated that it is produced by the p450 mediated demethylation of nicotine followed by acylation and nitrosation at the N position thereby producing a series of N-acylnornicotines and N-nitrosonornicotines. N-demethylation, catalyzed by a putative p450 demethylase, is thought to be a primary source of nornicotine biosyntheses in *Nicotiana*. While the enzyme is believed to be microsomal, thus far a nicotine demethylase enzyme has not been successfully purified, nor have the genes involved been isolated.

Furthermore, it is hypothesized but not proven that the activity of p450 enzymes is genetically controlled and also strongly influenced by environment factors. For example, the demethylation of nicotine in *Nicotiana* is thought to increase substantially when the plants reach a mature stage. Furthermore, it is hypothesized yet not proven that the demethylase gene contains a transposable element that can inhibit translation of RNA when present.

The large multiplicity of p450 enzyme forms, their differing structure and function have made their research on *Nicotiana* p450 enzymes very difficult before the enclosed invention. In addition, cloning of p450 enzymes has been hampered at least in part because these membrane-localized proteins are typically present in low abundance and often unstable to purification. Hence, a need exists for the identification of p450 enzymes in plants and the nucleic acid sequences associated with those p450 enzymes. In particular, only a few cytochrome p450 proteins have been reported in *Nicotiana*. The inventions described herein entail the discovery of a substantial number of cytochrome p450 fragments that correspond to several groups of p450 species based on their sequence identity.

SUMMARY

The present invention is directed to plant p450 enzymes. The present invention is further directed to plant p450 enzymes from *Nicotiana*. The present invention is also directed to p450 enzymes in plants whose expression is induced by ethylene and/or plant senescence. The present invention is yet further directed to nucleic acid sequences in plants having enzymatic activities, for example, being categorized as oxygenase, demethylase and the like, or other and the use of those sequences to reduce or silence the expression or over-expression of these enzymes. The invention also relates to p450 enzymes found in plants containing higher nornicotine levels than plants exhibiting lower nornicotine levels.

In one aspect, the invention is directed to nucleic acid sequences as set forth in SEQ. ID. Nos. 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 95, 97, 99, 101, 103, 105, 107, 109, 111, 113, 115, 117, 119, 121, 123, 125, 127, 129, 131, 133, 135, 137, 139, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 356, 358, 360, 362, 364, 366, 368, 370, 372, 434, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 502, 503, 505, 507, 509, 511, 513, 515, 517, 519, 521, 523, 525, 527, 529, 531, 533 and 535.

In a second related aspect, those fragments containing greater than 75% identity in nucleic acid sequence were placed into groups dependent upon their identity in a region corresponding to the first nucleic acid following the cytochrome p450 motif GXRXCX(G/A) (SEQ ID NO:547) to the stop codon. The representative nucleic acid groups and respective species are shown in Table I.

In a third aspect, the invention is directed to amino acid sequences as set forth in SEQ. ID. Nos. 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 96, 98, 100, 102, 104, 106, 108, 110, 112, 114, 116, 118, 120, 122, 124, 126, 128, 130, 132, 134, 136, 138, 140, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 297-355, 357, 359, 361, 363, 365, 367, 369, 371, 373, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534 and 536.

In a fourth related aspect, those fragments containing greater than 71% identity in amino acid sequence were placed into groups dependent upon their identity to each other in a region corresponding to the first amino acid following the cytochrome p450 motif GXRXCX(G/A) (SEQ ID NO:547) to the stop codon. The representative amino acid groups and respective species are shown in Table II.

In a fifth aspect, the invention is directed to amino acid sequences of full length genes as set forth in SEQ. ID. Nos. 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312 and 314.

In a sixth related aspect, those full length genes containing 85% or greater identity in amino acid sequence were placed into groups dependent upon the identity to each other. The representative amino acid groups and respective species are shown in Table III.

In a seventh aspect, the invention is directed to amino acid sequences of the fragments set forth in SEQ. ID. Nos. 297-355.

In the eighth related aspect, those fragments containing 90% or greater identity in amino acid sequence were placed into groups dependent upon their identity to each other in a region corresponding to the first cytochrome p450 domain, UXXRXXZ (SEQ ID NO:548), to the third cytochrome domain, GXRXO (SEQ ID NO:549), where U is E or K, X is any amino acid and Z is R, T, S or M. The representative amino acid groups respective species shown in Table IV.

In a ninth related aspect, the reduction or elimination or over-expression of p450 enzymes in *Nicotiana* plants may be accomplished transiently using RNA viral systems.

Resulting transformed or infected plants are assessed for phenotypic changes including, but not limited to, analysis of endogenous p450 RNA transcripts, p450 expressed peptides, and concentrations of plant metabolites using techniques commonly available to one having ordinary skill in the art.

In a tenth important aspect, the present invention is also directed to generation of transgenic *Nicotiana* lines that have altered p450 enzyme activity levels. In accordance with the invention, these transgenic lines include nucleic acid sequences that are effective for reducing or silencing or increasing the expression of certain enzyme thus resulting in phenotypic effects within *Nicotiana*. Such nucleic acid sequences include SEQ. ID. Nos. 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 95, 97, 99, 101, 103, 105, 107, 109, 111, 113, 115, 117, 119, 121, 123, 125, 127, 129, 131, 133, 135, 137, 139, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311 and 313.

In a very important eleventh aspect of the invention, plant cultivars including nucleic acids of the present invention in a down regulation capacity using either full length genes or fragments thereof or in an over-expression capacity using full length genes will have altered metabolite profiles relative to control plants.

In a twelfth aspect of the invention, plant cultivars including nucleic acid of the present invention using either full length genes or fragments thereof in modifying the biosynthesis or breakdown of metabolites derived from the plant or external to the plants, will have use in tolerating certain exogenous chemicals or plant pests. Such nucleic acid sequences include SEQ ID. Nos. 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 95, 97, 99, 101, 103, 105, 107, 109, 111, 113, 115, 117, 119, 121, 123, 125, 127, 129, 131, 133, 135, 137, 139, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 356, 358, 360, 362, 364, 366, 368, 370, 372, 434, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 502, 503, 505, 507, 509, 511, 513, 515, 517, 519, 521, 523, 525, 527, 529, 531, 533 and 535.

In a thirteenth aspect, the present invention is directed to the screening of plants, more preferably *Nicotiana*, that contain genes that have substantial nucleic acid identity to the taught nucleic acid sequence. The use of the invention would be advantageous to identify and select plants that contain a nucleic acid sequence with exact or substantial identity where such plants are part of a breeding program for traditional or transgenic varieties, a mutagenesis program, or naturally occurring diverse plant populations. The screening of plants for substantial nucleic acid identity may be accomplished by evaluating plant nucleic acid materials using a nucleic acid probe in conjunction with nucleic acid detection protocols including, but not limited to, nucleic acid hybridization and PCR analysis. The nucleic acid probe may consist of the taught nucleic acid sequence or fragment thereof corresponding to SEQ ID 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 95, 97, 99, 101, 103, 105, 107, 109, 111, 113, 115, 117, 119, 121, 123, 125, 127, 129, 131, 133, 135, 137, 139, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 356, 358, 360, 362, 364, 366, 368, 370, 372, 434, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 502, 503, 505, 507, 509, 511, 513, 515, 517, 519, 521, 523, 525, 527, 529, 531, 533 and 535.

In a fourteenth aspect, the present invention is directed to the identification of plant genes, more preferably *Nicotiana*, that share substantial amino acid identity corresponding to the taught nucleic acid sequence. The identification of plant genes including both cDNA and genomic clones, those cDNAs and genomic clones, more preferably from *Nicotiana* may be accomplished by screening plant cDNA libraries using a nucleic acid probe in conjunction with nucleic acid detection protocols including, but not limited to, nucleic acid hybridization and PCR analysis. The nucleic acid probe may be comprised of nucleic acid sequence or fragment thereof corresponding to SEQ ID 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 95, 97, 99, 101, 103, 105, 107, 109, 111, 113, 115, 117, 119, 121, 123, 125, 127, 129, 131, 133, 135, 137, 139, 143, 145 and 147.

In an alternative fifteenth aspect, cDNA expression libraries that express peptides may be screened using antibodies directed to part or all of the taught amino acid sequence. Such amino acid sequences include SEQ ID 2, 4, 8, 9, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 96, 98, 100, 102, 104, 106, 108, 110, 112, 114, 116, 118, 120, 122, 124, 126, 128, 130, 132, 134, 136, 138, 140, 144, 146, 148.

In a sixteenth important aspect, the present invention is also directed to generation of transgenic *Nicotiana* lines that have over-expression of p450 enzyme activity levels. In accordance with the invention, these transgenic lines include all nucleic acid sequences encoding the amino acid sequences of full length genes that are effective for increasing the expression of certain enzyme thus resulting in phenotypic effects within *Nicotiana*. Such amino acid sequences include SEQ. ID. 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312 and 314.

BRIEF DESCRIPTION OF THE DRAWINGS

FIG. 1 shows Amino Acid Identity of Group Members.
FIG. 2 shows a comparison of Sequence Groups.
FIG. 3 illustrates alignment of full length clones.
FIG. 4 shows a procedure used for cloning of cytochrome p450 cDNA fragments by PCR.
FIG. 5 shows probe set sequences of all clones on Gene-Chip.

DETAILED DESCRIPTION

Definitions

Unless defined otherwise, all technical and scientific terms used herein have the same meaning as commonly understood by one of ordinary skill in the art to which this invention belongs. Singleton et al. (1994) Dictionary of Microbiology and Molecular Biology, second edition, John Wiley and Sons (New York) provides one of skill with a general dictionary of many of the terms used in this invention. All patents and publications referred to herein are incorporated by reference herein. For purposes of the present invention, the following terms are defined below.

"Enzymatic activity" is meant to include demethylation, hydroxylation, epoxidation, N-oxidation, sulfooxidation, N-, S-, and O-dealkylations, desulfation, deamination, and reduction of azo, nitro, and N-oxide groups. The term "nucleic acid" refers to a deoxyribonucleotide or ribonucleotide polymer in either single- or double-stranded form, or sense or anti-sense, and unless otherwise limited, encompasses known analogues of natural nucleotides that hybridize to nucleic acids in a manner similar to naturally occurring nucleotides. Unless otherwise indicated, a particular nucleic acid sequence includes the complementary sequence thereof. The terms "operably linked", "in operable combination", and "in operable order" refer to functional linkage between a nucleic acid expression control sequence (such as a promoter, signal sequence, or array of transcription factor binding sites) and a second nucleic acid sequence, wherein the expression control sequence affects transcription and/or translation of the nucleic acid corresponding to the second sequence.

The term "recombinant" when used with reference to a cell indicates that the cell replicates a heterologous nucleic acid, expresses said nucleic acid or expresses a peptide, heterologous peptide, or protein encoded by a heterologous nucleic acid. Recombinant cells can express genes or gene fragments in either the sense or antisense form that are not found within the native (non-recombinant) form of the cell. Recombinant cells can also express genes that are found in the native form of the cell, but wherein the genes are modified and re-introduced into the cell by artificial means.

A "structural gene" is that portion of a gene comprising a DNA segment encoding a protein, polypeptide or a portion thereof, and excluding the 5' sequence which drives the initiation of transcription. The structural gene may alternatively encode a nontranslatable product. The structural gene may be one which is normally found in the cell or one which is not normally found in the cell or cellular location wherein it is introduced, in which case it is termed a "heterologous gene". A heterologous gene may be derived in whole or in part from any source known to the art, including a bacterial genome or episome, eukaryotic, nuclear or plasmid DNA, cDNA, viral DNA or chemically synthesized DNA. A structural gene may contain one or more modifications that could effect biological activity or its characteristics, the biological activity or the chemical structure of the expression product, the rate of expression or the manner of expression control. Such modifications include, but are not limited to, mutations, insertions, deletions and substitutions of one or more nucleotides. The structural gene may constitute an uninterrupted coding sequence or it may include one or more introns, bounded by the appropriate splice junctions. The structural gene may be translatable or non-translatable, including in an anti-sense orientation. The structural gene may be a composite of segments derived from a plurality of sources and from a plurality of gene sequences (naturally occurring or synthetic, where synthetic refers to DNA that is chemically synthesized).

"Derived from" is used to mean taken, obtained, received, traced, replicated or descended from a source (chemical and/or biological). A derivative may be produced by chemical or biological manipulation (including, but not limited to, substitution, addition, insertion, deletion, extraction, isolation, mutation and replication) of the original source.

"Chemically synthesized", as related to a sequence of DNA, means that portions of the component nucleotides were assembled in vitro. Manual chemical synthesis of DNA may be accomplished using well established procedures (Caruthers, *Methodology of DNA and RNA Sequencing*, (1983), Weissman (ed.), Praeger Publishers, New York, Chapter 1); automated chemical synthesis can be performed using one of a number of commercially available machines.

Optimal alignment of sequences for comparison may be conducted by the local homology algorithm of Smith and Waterman, Adv. Appl. Math. 2:482 (1981), by the homology alignment algorithm of Needleman and Wunsch, J. Mol. Biol. 48:443 (1970), by the search for similarity method of Pearson and Lipman Proc. Natl. Acad. Sci. (U.S.A.) 85: 2444 (1988), by computerized implementations of these algorithms (GAP, BESTFIT, FASTA, and TFASTA in the Wisconsin Genetics Software Package, Genetics Computer Group, 575 Science Dr., Madison, Wis.), or by inspection.

The NCBI Basic Local Alignment Search Tool (BLAST) (Altschul et al., 1990) is available from several sources, including the National Center for Biological Information (NCBI, Bethesda, Md.) and on the Internet, for use in connection with the sequence analysis programs blastp, blastn, blastx, tblastn and tblastx. It can be accessed at ncbi.nlm.nih.gov/BLAST/on the World Wide Web. A description of how to determine sequence identity using this program is available at ncbi.nlm.nih.gov/BLAST/blast help.html on the World Wide Web.

The terms "substantial amino acid identity" or "substantial amino acid sequence identity" as applied to amino acid sequences and as used herein denote a characteristic of a polypeptide, wherein the peptide comprises a sequence that has at least 70 percent sequence identity, preferably 80 percent amino acid sequence identity, more preferably 90 percent amino acid sequence identity, and most preferably at least 99 to 100 percent sequence identity as compared to a reference group over region corresponding to the first amino acid following the cytochrome p450 motif GXRXCX(G/A) (SEQ ID NO:547) to the stop codon of the translated peptide.

The terms "substantial nucleic acid identity" or "substantial nucleic acid sequence identity" as applied to nucleic acid sequences and as used herein denote a characteristic of a polynucleotide sequence, wherein the polynucleotide comprises a sequence that has at least 75 percent sequence identity, preferably 81 percent sequence identity, more preferably at least 91 percent sequence identity, and most preferably at least 99 to 100 percent sequence identity as compared to a reference group over region corresponding to the first nucleic acid following the cytochrome p450 motif GXRXCX(G/A) (SEQ ID NO:547) to the stop codon of the translated peptide.

Another indication that nucleotide sequences are substantially identical is if two molecules hybridize to each other under stringent conditions. Stringent conditions are sequence-dependent and will be different in different circumstances. Generally, stringent conditions are selected to be about 5° C. to about 20° C., usually about 10° C. to about 15° C., lower than the thermal melting point (Tm) for the specific sequence at a defined ionic strength and pH. The Tm is the temperature (under defined ionic strength and pH) at which 50% of the target sequence hybridizes to a matched probe. Typically, stringent conditions will be those in which the salt concentration is about 0.02 molar at pH 7 and the temperature is at least about 60° C. For instance in a standard Southern hybridization procedure, stringent conditions will include an initial wash in 6×SSC at 42° C. followed by one or more additional washes in 0.2×SSC at a temperature of at least about 55° C., typically about 60° C. and often about 65° C.

Nucleotide sequences are also substantially identical for purposes of this invention when the polypeptides and/or proteins which they encode are substantially identical. Thus, where one nucleic acid sequence encodes essentially the same polypeptide as a second nucleic acid sequence, the two nucleic acid sequences are substantially identical, even if they would not hybridize under stringent conditions due to degeneracy permitted by the genetic code (see, Darnell et al. (1990) Molecular Cell Biology, Second Edition Scientific American Books W. H. Freeman and Company New York for an explanation of codon degeneracy and the genetic code). Protein purity or homogeneity can be indicated by a number of means well known in the art, such as polyacrylamide gel electrophoresis of a protein sample, followed by visualization upon staining. For certain purposes high resolution may be needed and HPLC or a similar means for purification may be utilized.

As used herein, the term "vector" is used in reference to nucleic acid molecules that transfer DNA segment(s) into a cell. A vector may act to replicate DNA and may reproduce independently in a host cell. The term "vehicle" is sometimes used interchangeably with "vector." The term "expression vector" as used herein refers to a recombinant DNA molecule containing a desired coding sequence and appropriate nucleic acid sequences necessary for the expression of the operably linked coding sequence in a particular host organism. Nucleic acid sequences necessary for expression in prokaryotes usually include a promoter, an operator (optional), and a ribosome binding site, often along with other sequences. Eucaryotic cells are known to utilize promoters, enhancers, and termination and polyadenylation signals.

For the purpose of regenerating complete genetically engineered plants with roots, a nucleic acid may be inserted into plant cells, for example, by any technique such as in vivo inoculation or by any of the known in vitro tissue culture techniques to produce transformed plant cells that can be regenerated into complete plants. Thus, for example, the insertion into plant cells may be by in vitro inoculation by pathogenic or non-pathogenic *A. tumefaciens*. Other such tissue culture techniques may also be employed.

"Plant tissue" includes differentiated and undifferentiated tissues of plants, including, but not limited to, roots, shoots, leaves, pollen, seeds, tumor tissue and various forms of cells in culture, such as single cells, protoplasts, embryos and callus tissue. The plant tissue may be in planta or in organ, tissue or cell culture.

"Plant cell" as used herein includes plant cells in planta and plant cells and protoplasts in culture. "cDNA" or "complementary DNA" generally refers to a single stranded DNA molecule with a nucleotide sequence that is complementary to an RNA molecule. cDNA is formed by the action of the enzyme reverse transcriptase on an RNA template.

Strategies for Obtaining Nucleic Acid Sequences

In accordance with the present invention, RNA was extracted from *Nicotiana* tissue of converter and non-converter *Nicotiana* lines. The extracted RNA was then used to create cDNA. Nucleic acid sequences of the present invention were then generated using two strategies.

In the first strategy, the poly A enriched RNA was extracted from plant tissue and cDNA was made by reverse transcription PCR. The single strand cDNA was then used to create p450 specific PCR populations using degenerate primers plus a oligo d(T) reverse primer. The primer design was based on the highly conserved motifs of p450. Sequence fragments from plasmids containing appropriate size inserts were further analyzed. These size inserts typically ranged from about 300 to about 800 nucleotides depending on which primers were used.

In a second strategy, a cDNA library was initially constructed. The cDNA in the plasmids was used to create p450 specific PCR populations using degenerate primers plus T7 primer on plasmid as reverse primer. As in the first strategy, sequence fragments from plasmids containing appropriate size inserts were further analyzed.

*Nicotiana* plant lines known to produce high levels of nornicotine (converter) and plant lines having undetectable levels of nornicotine may be used as starting materials.

Leaves can then be removed from plants and treated with ethylene to activate p450 enzymatic activities defined herein. Total RNA is extracted using techniques known in the art. cDNA fragments can then be generated using PCR(RT-PCR) with the oligo d(T) primer as described in FIG. 4. The cDNA library can then be constructed more fully described in examples herein.

The conserved region of p450 type enzymes can be used as a template for degenerate primers (FIG. 4). Using degenerate primers, p450 specific bands can be amplified by PCR. Bands indicative for p450 like enzymes can be identified by DNA sequencing. PCR fragments can be characterized using BLAST search, alignment or other tools to identify appropriate candidates.

Sequence information from identified fragments can be used to develop PCR primers. These primers in combination of plasmid primers in cDNA library were used to clone full length p450 genes. Large-scale Southern reverse analysis was conducted to examine the differential expression for all fragment clones obtained and in some cases full length clones. In this aspect of the invention, these large-scale reverse Southern assays can be conducted using labeled total cDNA's from different tissues as a probe to hybridize with cloned DNA fragments in order to screen all cloned inserts.

Nonradioactive and radioactive ($P^{32}$) Northern blotting assays were also used to characterize clones p450 fragments and full length clones.

Peptide specific antibodies were made against several full-length clones by deriving their amino acid sequence and selecting peptide regions that were antigenic and unique relative to other clones. Rabbit antibodies were made to synthetic peptides conjugated to a carrier protein. Western blotting analyses or other immunological methods were performed on plant tissue using these antibodies.

Nucleic acid sequences identified as described above can be examined by using virus induced gene silencing technology (VIGS, Baulcombe, Current Opinions in Plant Biology, 1999, 2:109-113).

Peptide specific antibodies were made for several full-length clones by deriving their amino acid sequence and selecting peptide regions that were potentially antigenic and were unique relative to other clones. Rabbit antibodies were made to synthetic peptides conjugated to a carrier protein. Western blotting analyses were performed using these antibodies.

In another aspect of the invention, interfering RNA technology (RNAi) is used to further characterize cytochrome p450 enzymatic activities in *Nicotiana* plants of the present invention. The following references which describe this technology are incorporated by reference herein, Smith et al., Nature, 2000, 407:319-320; Fire et al., Nature, 1998, 391: 306-311; Waterhouse et al., PNAS, 1998, 95:13959-13964; Stalberg et al., Plant Molecular Biology, 1993, 23:671-683; Baulcombe, Current Opinions in Plant Biology, 1999, 2:109-113; and Brigneti et al., EMBO Journal, 1998, 17(22):6739-6746. Plants may be transformed using RNAi techniques, antisense techniques, or a variety of other methods described.

Several techniques exist for introducing foreign genetic material into plant cells, and for obtaining plants that stably maintain and express the introduced gene. Such techniques include acceleration of genetic material coated onto microparticles directly into cells (U.S. Pat. No. 4,945,050 to Cornell and U.S. Pat. No. 5,141,131 to DowElanco). Plants may be transformed using *Agrobacterium* technology, see U.S. Pat. No. 5,177,010 to University of Toledo, U.S. Pat. No. 5,104,310 to Texas A&M, European Patent Application 0131624B1, European Patent Applications 120516, 159418B1, European Patent Applications 120516, 159418B1 and 176,112 to Schilperoot, U.S. Pat. Nos. 5,149,645, 5,469, 976, 5,464,763 and 4,940,838 and 4,693,976 to Schilperoot, European Patent Applications 116718, 290799, 320500 all to MaxPlanck, European Patent Applications 604662 and 627752 to Japan *Nicotiana*, European Patent Applications 0267159, and 0292435 and U.S. Pat. No. 5,231,019 all to Ciba Geigy, U.S. Pat. Nos. 5,463,174 and 4,762,785 both to Calgene, and U.S. Pat. Nos. 5,004,863 and 5,159,135 both to Agracetus. Other transformation technology includes whiskers technology, see U.S. Pat. Nos. 5,302,523 and 5,464,765 both to Zeneca. Electroporation technology has also been used to transform plants, see WO 87/06614 to Boyce Thompson Institute, U.S. Pat. Nos. 5,472,869 and 5,384,253 both to Dekalb, WO9209696 and WO9321335 both to PGS. All of these transformation patents and publications are incorporated by reference. In addition to numerous technologies for transforming plants, the type of tissue which is contacted with the foreign genes may vary as well. Such tissue would include but would not be limited to embryogenic tissue, callus tissue type I and II, hypocotyl, meristem, and the like. Almost all plant tissues may be transformed during dedifferentiation using appropriate techniques within the skill of an artisan.

Foreign genetic material introduced into a plant may include a selectable marker. The preference for a particular marker is at the discretion of the artisan, but any of the following selectable markers may be used along with any other gene not listed herein which could function as a selectable marker. Such selectable markers include but are not limited to aminoglycoside phosphotransferase gene of transposon Tn5 (Aph II) which encodes resistance to the antibiotics kanamycin, neomycin and G418, as well as those genes which code for resistance or tolerance to glyphosate; hygromycin; methotrexate; phosphinothricin (bar); imidazolinones, sulfonylureas and triazolopyrimidine herbicides, such as chlorosulfuron; bromoxynil, dalapon and the like.

In addition to a selectable marker, it may be desirous to use a reporter gene. In some instances a reporter gene may be used without a selectable marker. Reporter genes are genes which are typically not present or expressed in the recipient organism or tissue. The reporter gene typically encodes for a protein which provide for some phenotypic change or enzymatic property. Examples of such genes are provided in K. Weising et al. Ann. Rev. Genetics, 22, 421 (1988), which is incorporated herein by reference. Preferred reporter genes include without limitation glucuronidase (GUS) gene and GFP genes.

Once introduced into the plant tissue, the expression of the structural gene may be assayed by any means known to the art, and expression may be measured as mRNA transcribed, protein synthesized, or the amount of gene silencing that occurs (see U.S. Pat. No. 5,583,021 which is hereby incorporated by reference). Techniques are known for the in vitro culture of plant tissue, and in a number of cases, for regeneration into whole plants (EP Appln No. 88810309.0). Procedures for transferring the introduced expression complex to commercially useful cultivars are known to those skilled in the art.

Once plant cells expressing the desired level of p450 enzyme are obtained, plant tissues and whole plants can be regenerated therefrom using methods and techniques well-known in the art. The regenerated plants are then reproduced by conventional means and the introduced genes can be transferred to other strains and cultivars by conventional plant breeding techniques.

The following examples illustrate methods for carrying out the invention and should be understood to be illustrative of, but not limiting upon, the scope of the invention which is defined in the appended claims.

EXAMPLES

Example I

Development of Plant Tissue and Ethylene Treatment

Plant Growth

Plants were seeded in pots and grown in a greenhouse for 4 weeks. The 4 week old seedlings were transplanted into individual pots and grown in the greenhouse for 2 months. The plants were watered 2 times a day with water containing 150 ppm NPK fertilizer during growth. The expanded green leaves were detached from plants to do the ethylene treatment described below.

Cell Line 78379

Tobacco line 78379, which is a burley tobacco line released by the University of Kentucky was used as a source of plant material. One hundred plants were cultured as standard in the art of growing tobacco and transplanted and tagged with a distinctive number (1-100). Fertilization and field management were conducted as recommended.

Three quarters of the 100 plants converted between 20 and 100% of the nicotine to nornicotine. One quarter of the 100 plants converted less than 5% of the nicotine to nornicotine. Plant number 87 had the least conversion (2%) while plant number 21 had 100% conversion. Plants converting less than 3% were classified as non-converters. Self-pollinated seed of plant number 87 and plant number 21, as well as crossed (21×87 and 87×21) seeds were made to study genetic and phenotypic differences. Plants from selfed 21 were converters, and 99% of selfs from 87 were non-converters. The other 1% of the plants from 87 showed low conversion (5-15%). Plants from reciprocal crosses were all converters.

Cell Line 4407

*Nicotiana* line 4407, which is a burley line was used as a source of plant material. Uniform and representative plants (100) were selected and tagged. Of the 100 plants 97 were non-converters and three were converters. Plant number 56 had the least amount of conversion (1.2%) and plant number 58 had the highest level of conversion (96%). Self-pollinated seeds and crossed seeds were made with these two plants.

Plants from selfed-58 segregated with 3:1 converter to non-converter ratio. Plants 58-33 and 58-25, were identified as homozygous converter and nonconverter plant lines, respectively. The stable conversion of 58-33 was confirmed by analysis of its progenies of next generation.

Cell Line PBLB01

PBLB01 is a burley line developed by ProfiGen, Inc. and was used as a source of plant material. The converter plant was selected from foundation seeds of PBLB01.

Ethylene Treatment Procedures

Green leaves were detached from 2-3 month greenhouse grown plants and sprayed with 0.3% ethylene solution (Prep brand Ethephon (Rhone-Poulenc)). Each sprayed leaf was hung in a curing rack equipped with humidifier and covered with plastic. During the treatment, the sample leaves were periodically sprayed with the ethylene solution. Approximately 24-48 hour post ethylene treatment, leaves were collected for RNA extraction. Another sub-sample was taken for metabolic constituent analysis to determine the concentration of leaf metabolites and more specific constituents of interest such as a variety of alkaloids.

As an example, alkaloids analysis could be performed as follows. Samples (0.1 g) were shaken at 150 rpm with 0.5 ml 2N NaOH, and a 5 ml extraction solution which contained quinoline as an internal standard and methyl t-butyl ether. Samples were analyzed on a HP 6890 GC equipped with a FID detector. A temperature of 250° C. was used for the detector and injector. An HP column (30 m-0.32 nm-1 m) consisting of fused silica crosslinked with 5% phenol and 95% methyl silicon was used at a temperature gradient of 110-185° C. at 10° C. per minute. The column was operated at 100° C. with a flow rate of 1.7 $cm^3$ $min^{-1}$ with a split ratio of 40:1 with a 2.1 injection volume using helium as the carrier gas.

Example 2

RNA Isolation

For RNA extractions, middle leaves from 2 month old greenhouse grown plants were treated with ethylene as described. The 0 and 24-48 hours samples were used for RNA extraction. In some cases, leaf samples under the senescence process were taken from the plants 10 days post flower-head removal. These samples were also used for extraction. Total RNA was isolated using Rneasy Plant Mini Kit® (Qiagen, Inc., Valencia, Calif.) following manufacturer's protocol.

The tissue sample was ground under liquid nitrogen to a fine powder using a DEPC treated mortar and pestle. Approximately 100 milligrams of ground tissue were transferred to a sterile 1.5 ml eppendorf tube. This sample tube was placed in liquid nitrogen until all samples were collected. Then, 450µ-l of Buffer RLT as provided in the kit (with the addition of Mercaptoethanol) was added to each individual tube. The sample was vortexed vigorously and incubated at 56° C. for 3 minutes. The lysate was then, applied to the QIAshredder™ spin column sitting in a 2-ml collection tube, and centrifuged for 2 minutes at maximum speed. The flow through was collected and 0.5 volume of ethanol was added to the cleared lysate. The sample is mixed well and transferred to an Rneasy® mini spin column sitting in a 2 ml collection tube. The sample was centrifuged for 1 minute at 10,000 rpm. Next, 700 µl of buffer RW1 was pipetted onto the Rneasy® column and centrifuged for 1 minute at 10,000 rpm. Buffer RPE was pipetted onto the Rneasy® column in a new collection tube and centrifuged for 1 minute at 10,000 rpm. Buffer RPE was again, added to the Rneasy® spin column and centrifuged for 2 minutes at maximum speed to dry the membrane. To eliminate any ethanol carry over, the membrane was placed in a separate collection tube and centrifuged for an additional 1 minute at maximum speed. The Rneasy® column was transferred into a new 1.5 ml collection tube, and 40 µl of Rnase-free water was pipetted directly onto the Rneasy® membrane. This final elute tube was centrifuged for 1 minute at 10,000 rpm. Quality and quantity of total RNA was analyzed by denatured formaldehyde gel and spectrophotometer.

Poly(A)RNA was isolated using Oligotex™ poly A+ RNA purification kit (Qiagen Inc.) following manufacture's protocol. About 200 µg total RNA in 250 µl maximum volume was used. A volume of 250 µl of Buffer OBB and 15 µl of Oligotex™ suspension was added to the 250 µl of total RNA. The contents were mixed thoroughly by pipetting and incubated for 3 minutes at 70° C. on a heating block. The sample was then, placed at room temperature for approximately 20 minutes. The oligotex:mRNA complex was pelleted by centrifugation for 2 minutes at maximum speed. All but 50 µl of the supernatant was removed from the microcentrifuge tube. The sample was treated further by OBB buffer. The oligotex:mRNA pellet was resuspended in 400 µl of Buffer OW2 by vortexing. This mix was transferred onto a small spin column placed in a new tube and centrifuged for 1 minute at maximum speed. The spin column was transferred to a new tube and an additional 400 µl of Buffer OW2 was added to the column. The tube was then centrifuged for 1 minute at maximum speed. The spin column was transferred to a final 1.5 ml microcentrifuge tube. The sample was eluted with 60 ul of hot (70° C.) Buffer OEB. Poly A product was analyzed by denatured formaldehyde gels and spectrophotometric analysis.

Example 3

Reverse Transcription-PCR

First strand cDNA was produced using SuperScript reverse transcriptase following manufacturer's protocol (Invitrogen, Carlsbad, Calif.). The poly A+ enriched RNA/oligo dT primer mix consisted of less than 5 µg of total RNA, 1 µl of 10 mM dNTP mix, 1 µl of Oligo d(T)$_{12-18}$ (0.5 µg/µl), and up to 10 µl of DEPC-treated water. Each sample was incubated at 65° C. for 5 minutes, then placed on ice for at least 1 minute. A reaction mixture was prepared by adding each of the following components in order: 2 µl 10×RT buffer, 4 µl of 25 mM MgCl12, 2 µl of 0.1 M DTT, and 1 µl of RNase OUT Recombinant RNase Inhibitor. An addition of 9 µl of reaction mixture was pipetted to each RNA/primer mixture and gently mixed. It was incubated at 42° C. for 2 minutes and 1 µl of Super Script II™ RT was added to each tube. The tube was incubated for 50 minutes at 42° C. The reaction was terminated at 70° C. for 15 minutes and chilled on ice. The sample was collected by centrifugation and 1 µl of RNase H was added to each tube and incubated for 20 minutes at 37° C. The second PCR was carried out with 200 pmoles of forward primer (degenerate primers as in SEQ. ID Nos. 538-543) and 100 pmoles reverse primer (mix of 18 nt oligo d(T) followed by 1 random base).

Reaction conditions were 94° C. for 2 minutes and then performed 40 cycles of PCR at 94° C. for 1 minute, 45° to 60° C. for 2 minutes, 72° C. for 3 minutes with a 72° C. extension for an extra 10 min.

Ten microliters of the amplified sample were analyzed by electrophoresis using a 1% agarose gel. The correct size fragments were purified from agarose gel.

Example 4

Generation of PCR Fragment Populations

PCR fragments from Example 3 were ligated into a pGEM-T® Easy Vector (Promega, Madison, Wis.) following manufacturer's instructions. The ligated product was transformed into JM109 competent cells and plated on LB media plates for blue/white selection. Colonies were selected and grown in a 96 well plate with 1.2 ml of LB media overnight at 37° C. Frozen stock was generated for all selected colonies. Plasmid DNA from plates were purified using Beckman's Biomeck 2000 miniprep robotics with Wizard SV Miniprep® kit (Promega). Plasmid DNA was eluted with 100 µl water and stored in a 96 well plate. Plasmids were digested by EcoRI and were analyzed using 1% agarose gel to confirm the DNA quantity and size of inserts. The plasmids containing a 400-600 by insert were sequenced using an CEQ 2000 sequencer (Beckman, Fullerton, Calif.). The sequences were aligned with GenBank database by BLAST search. The p450 related fragments were identified and further analyzed. Alternatively, p450 fragments were isolated from subtraction libraries. These fragments were also analyzed as described above.

Example 5

Construction of cDNA Library

A cDNA library was constructed by preparing total RNA from ethylene treated leaves as follows. First, total RNA was extracted from ethylene treated leaves of tobacco line 58-33 using a modified acid phenol and chloroform extraction protocol. Protocol was modified to use one gram of tissue that was ground and subsequently vortexed in 5 ml of extraction buffer (100 mM Tris-HCl, pH 8.5; 200 mM NaCl; 10 mM EDTA; 0.5% SDS) to which 5 ml phenol (pH5.5) and 5 ml chloroform was added. The extracted sample was centrifuged and the supernatant was saved. This extraction step was repeated 2-3 more times until the supernatant appeared clear. Approximately 5 ml of chloroform was added to remove trace amounts of phenol. RNA was precipitated from the combined supernatant fractions by adding a 3-fold volume of ETOH and ⅒ volume of 3M NaOAc (pH5.2) and storing at −20° C. for 1 hour. After transferring to a Corex glass container the RNA fraction was centrifuged at 9,000 RPM for 45 minutes at 4° C. The pellet was washed with 70% ethanol and spun for 5 minutes at 9,000 RPM at 4° C. After drying the pellet, the pelleted RNA was dissolved in 0.5 ml RNase free water. The pelleted RNA was dissolved in 0.5 ml RNase free water. The quality and quantity of total RNA was analyzed by denatured formaldehyde gel and spectrophotometer, respectively.

The resultant total RNA was isolated for poly A+ RNA using an Oligo(dT) cellulose protocol (Invitrogen) and Microcentrifuge spin columns (Invitrogen) by the following protocol. Approximately twenty mg of total RNA was subjected to twice purification to obtain high quality poly A+ RNA. Poly A+ RNA product was analyzed by performing denatured formaldehyde gel and subsequent RT-PCR of known full-length genes to ensure high quality of mRNA.

Next, poly A+ RNA was used as template to produce a cDNA library employing cDNA synthesis kit, ZAP-cDNA® synthesis kit, and ZAP-cDNA® Gigapack® III gold cloning kit (Stratagene, La Jolla, Calif.). The method involved following the manufacture's protocol as specified. Approximately 8 µg of poly A+ RNA was used to construct cDNA library. Analysis of the primary library revealed about 2.5× $10^6$-1×$10^7$ pfu. A quality background test of the library was completed by complementation assays using IPTG and X-gal, where recombinant plaques was expressed at more than 100-fold above the background reaction.

A more quantitative analysis of the library by random PCR showed that average size of insert cDNA was approximately 1.2 kb. The method used a two-step PCR method as followed. For the first step, reverse primers were designed based on the preliminary sequence information obtained from p450 fragments. The designed reverse primers and T3 (forward) primers were used amplify corresponding genes from the cDNA library. PCR reactions were subjected to agarose electrophoresis and the corresponding bands of high molecular weight were excised, purified, cloned and sequenced. In the second step, new primers designed from 5'UTR or the start coding region of p450 as the forward primers together with the reverse primers (designed from 3'UTR of p450) were used in the subsequent PCR to obtain full-length p450 clones.

The p450 fragments were generated by PCR amplification from the constructed cDNA library as described in Example 3 with the exception of the reverse primer. The T7 primer located on the plasmid downstream of cDNA inserts (see FIG. 4) was used as a reverse primer. PCR fragments were isolated, cloned and sequenced as described in Example 4.

Full-length p450 genes were isolated by PCR method from constructed cDNA library. Gene specific reverse primers (designed from the downstream sequence of p450 fragments) and a forward primer (T3 on library plasmid) were used to clone the full length genes. PCR fragments were isolated, cloned and sequenced. If necessary, second step PCR was applied. In the second step, new forward primers designed from 5'UTR of cloned p450s together with the reverse primers designed from 3'UTR of p450 clones were used in the subsequent PCR reactions to obtain full-length p450 clones. The clones were subsequently sequenced.

Example 6

Characterization of Cloned Fragments—Reverse Southern Blotting Analysis

Nonradioactive large scale reverse southern blotting assays were performed on all p450 clones identified in above examples to detect the differential expression. It was observed that the level of expression among different p450 clusters was very different. Further real time detection was conducted on those with high expression.

Nonradioactive Southern blotting procedures were conducted as follows.

1) Total RNA was extracted from ethylene treated and nontreated converter (58-33) and nonconverter (58-25) leaves using the Qiagen Rnaeasy kit as described in Example 2.

2) Probe was produced by biotin-tail labeling a single strand cDNA derived from poly A+ enriched RNA generated in above step. This labeled single strand cDNA was generated by RT-PCR of the converter and nonconverter total RNA (Invitrogen) as described in Example 3 with the exception of using biotinalyted oligo dT as a primer (Promega). These were used as a probe to hybridize with cloned DNA.

3) Plasmid DNA was digested with restriction enzyme EcoRI and run on agarose gels. Gels were simultaneously dried and transferred to two nylon membranes (Biodyne B®). One membrane was hybridized with converter probe and the other with nonconverter probe. Membranes were UV-crosslinked (auto crosslink setting, 254 nm, Stratagene, Stratalinker) before hybridization.

Alternatively, the inserts were PCR amplified from each plasmid using the sequences located on both arms of p-GEM plasmid, T3 and SP6, as primers. The PCR products were analyzed by running on a 96 well Ready-to-run agarose gels. The confirmed inserts were dotted on two nylon membranes. One membrane was hybridized with converter probe and the other with nonconverter probe.

4) The membranes were hybridized and washed following manufacture's instruction with the modification of washing stringency (Enzo MaxSence™ kit, Enzo Diagnostics, Inc, Farmingdale, N.Y.). The membranes were prehybridized with hybridization buffer (2×SSC buffered formamide, containing detergent and hybridization enhancers) at 42° C. for 30 min and hybridized with 10 µl denatured probe overnight at 42° C. The membranes then were washed in 1× hybridization wash buffer 1 time at room temperature for 10 min and 4 times at 68° C. for 15 min. The membranes were ready for the detection.

5) The washed membranes were detected by alkaline phosphatase labeling followed by NBT/BCIP colometric detection as described in manufacture's detection procedure (Enzo Diagnostics, Inc.). The membranes were blocked for one hour at room temperature with 1× blocking solution, washed 3 times with 1× detection reagents for 10 min, washed 2 times with 1× predevelopment reaction buffer for 5 min and then developed the blots in developing solution for 30-45 min until the dots appear. All reagents were provided by manufacture (Enzo Diagnostics, Inc). In Addition, large scale reverse Southern assay was also performed using KPL southern hybridization and detection kit' following manfacturer's instruction (KPL, Gaithersburg, Md.).

Example 7

Characterization of Clones—Northern Blot Analysis

Alternative to Southern Blot analysis, some membranes were hybridized and detected as described in the example of Northern blotting assays. Northern Hybridization was used to detect mRNA differentially expressed in *Nicotiana* as follows.

A random priming method was used to prepare probes from cloned p450 (Megaprime™ DNA Labelling Systems, Amersham Biosciences).

The following components were mixed: 25 ng denatured DNA template; 4 ul of each unlabeled dTTP, dGTP and dCTP; 5 ul of reaction buffer; $P^{32}$-labelled dATP and 2 µl of Klenow I; and $H_2O$, to bring the reaction to 50 µl. The mixture was incubated in 37° C. for 1-4 hours, then stopped with 2 µl of 0.5 M EDTA. The probe was denatured by incubating at 95° C. for 5 minutes before use.

RNA samples were prepared from ethylene treated and non-treated fresh leaves of several pairs of tobacco lines. In some cases poly A+ enriched RNA was used. Approximately 15 µg total RNA or 1.8 µg mRNA (methods of RNA and mRNA extraction as described in Example 5) were brought to equal volume with DEPC $H_2O$ (5-10 µl). The same volume of loading buffer (1×MOPS; 18.5% Formaldehyde; 50% Formamide; 4% Ficoll400; Bromophenolblue) and 0.5 µl EtBr (0.5 µg/µl) were added. The samples were subsequently denatured in preparation for separation of the RNA by electrophoresis.

Samples were subjected to electrophoresis on a formaldehyde gel (1% Agarose, 1×MOPS, 0.6 M Formaldehyde) with 1×MOP buffer (0.4 M Morpholinopropanesulfonic acid; 0.1 M Na-acetate-3×H2O; 10 mM EDTA; adjust to pH 7.2 with NaOH). RNA was transferred to a Hybond-N+membrane (Nylon, Amersham Pharmacia Biotech) by capillary method in 10×SSC buffer (1.5 M NaCl; 0.15 M Na-citrate) for 24 hours. Membranes with RNA samples were UV-crosslinked (auto crosslink setting, 254 nm, Stratagene, Stratalinker) before hybridization.

The membrane was prehybridized for 1-4 hours at 42° C. with 5-10 ml prehybridization buffer (5×SSC; 50% Formamide; 5×Denhardt's-solution; 1% SDS; 100 µg/ml heat-denatured sheared non-homologous DNA). Old prehybridization buffer was discarded, and new prehybridization buffer and probe were added. The hybridization was carried out over night at 42° C. The membrane was washed for 15 minutes with 2×SSC at room temperature, followed by a wash with 2×SSC.

A major focus of the invention was the discovery of novel genes that may be induced as a result of ethylene treatment or play a key role in tobacco leaf quality and constituents. As illustrated in the table below, Northern blots and reverse Southern Blot were useful in determining which genes were induced by ethylene treatment relative to non-induced plants. Interestingly, not all fragments were affected similarly in the converter and nonconverter. The cytochrome p450 fragments of interest were partially sequenced to determine their structural relatedness. This information was used to subsequently isolate and characterize full length gene clones of interest.

| Fragments | Induced mRNA Expression Ethylene Treatment Converter |
|---|---|
| D56-AC7 (SEQ ID No: 35) | + |
| D56-AG11 (SEQ ID No: 31) | + |
| D56-AC12 (SEQ ID No: 45) | + |
| D70A-AB5 (SEQ ID No: 95) | + |
| D73-AC9 (SEQ ID No: 43) | + |
| D70A-AA12 (SEQ ID No: 131) | + |
| D73A-AG3 (SEQ ID No: 129) | + |
| D34-52 (SEQ ID No: 61) | + |
| D56-AG6 (SEQ ID No: 51) | + |

Northern analysis was performed using full length clones on tobacco tissue obtained from converter and nonconverter burley lines that were induced by ethylene treatment. The purpose was to identify those full length clones that showed elevated expression in ethylene induced converter lines relative to ethylene induced converter lines relative to ethylene induced nonconverter burley lines. By so doing, the functionality relationship of full length clones may be determined by comparing biochemical differences in leaf constituents between converter and nonconverter lines. As shown in table below, six clones showed significantly higher expression, as denoted by ++ and +++, in converter ethylene treated tissue than that of nonconverter treated tissue, denoted by +. All of these clones showed little or no expression in converter and nonconverter lines that were not ethylene treated.

| Full Length Clones | Converter | Nonconverter |
|---|---|---|
| D101-BA2 | ++ | + |
| D207-AA5 | ++ | + |
| D208-AC8 | +++ | + |
| D237-AD1 | ++ | + |
| D89-AB1 | ++ | + |
| D90A-BB3 | ++ | + |

Example 8

Immunodetection of p450S Encoded by the Cloned Genes

Peptide regions corresponding to 20-22 amino acids in length from three p450 clones were selected for 1) having lower or no homology to other clones and 2) having good hydrophilicity and antigenicity. The amino acid sequences of the peptide regions selected from the respective p450 clones are listed below. The synthesized peptides were conjugated with KHL and then injected into rabbits. Antisera were collected 2 and 4 weeks after the 4$^{th}$ injection (Alpha Diagnostic Intl. Inc. San Antonio, Tex.).

```
D234-AD1    DIDGSKSKLVKAHRKIDEILG    (SEQ ID NO: 550)

D90a-BB3    RDAFREKETFDENDVEELNY     (SEQ ID NO: 551)

D89-AB1     FKNNGDEDRHFSQKLGDLADKY   (SEQ ID NO: 552)
```

Antisera were examined for crossreactivity to target proteins from tobacco plant tissue by Western Blot analysis. Crude protein extracts were obtained from ethylene treated (0 to 40 hours) middle leaves of converter and nonconverter lines. Protein concentrations of the extracts were determined using RC DC Protein Assay Kit (BIO-RAD) following the manufacturer's protocol.

Two micrograms of protein were loaded onto each lane and the proteins separated on 10%-20% gradient gels using the Laemmli SDS-PAGE system. The proteins were transferred from gels to PROTRAN® Nitrocellulose Transfer Membranes (Schleicher & Schuell) with the Trans-Blot® Semi-Dry cell (BIO-RAD). Target p450 proteins were detected and visualized with the ECL Advance™ Western Blotting Detection Kit (Amersham Biosciences). Primary antibodies against the synthetic-KLH conjugates were made in rabbits. Secondary antibody against rabbit IgG, coupled with peroxidase, was purchased from Sigma. Both primary and secondary antibodies were used at 1:1000 dilutions. Antibodies showed strong reactivity to a single band on the Western Blots indicating that the antisera were monospecific to the target peptide of interest. Antisera were also crossreactive with synthetic peptides conjugated to KLH.

Example 9

Nucleic Acid Identity and Structure Relatedness of Isolated Nucleic Acid Fragments Over 100 cloned p450 fragments were sequenced in conjunction with Northern blot analysis to determine their structural relatedness. The approach used forward primers based either of two common p450 motifs located near the carboxyl-terminus of the p450 genes. The forward primers corresponded to cytochrome p450 motifs FXPERF (SEQ ID NO:553) or GRRXCP(A/G) (SEQ ID NO:554) as denoted in FIG. 4. The reverse primers used standard primers from either the plasmid, SP6 or T7 located on both arms of pGEM™ plasmid, or a poly A tail. The protocol used is described below.

Spectrophotometry was used to estimate the concentration of starting double stranded DNA following the manufacturer's protocol (Beckman Coulter). The template was diluted with water to the appropriate concentration, denatured by heating at 95° C. for 2 minutes, and subsequently placed on ice. The sequencing reaction was prepared on ice using 0.5 to 10 µl of denatured DNA template, 2 µl of 1.6 pmole of the forward primer, 8 µl of DTCS Quick Start Master Mix and the total volume brought to 20 µl with water. The thermocycling program consisted of 30 cycles of the follow cycle: 96° C. for 20 seconds, 50° C. for 20 seconds, and 60° C. for 4 minutes followed by holding at 4° C.

The sequence was stopped by adding 5 µl of stop buffer (equal volume of 3M NaOAc and 100 mM EDTA and 1 µl of 20 mg/ml glycogen). The sample was precipitated with 60 µl of cold 95% ethanol and centrifuged at 6000 g for 6 minutes. Ethanol was discarded. The pellet was 2 washes with 200 µl of cold 70% ethanol. After the pellet was dry, 40 µl of SLS solution was added and the pellet was resuspended. A layer of mineral oil was over laid. The sample was then, placed on the CEQ 8000 Automated Sequencer for further analysis.

In order to verify nucleic acid sequences, nucleic acid sequence was re-sequenced in both directions using forward primers to the FXPERF (SEQ ID NO:553) or GRRXCP(A/G) (SEQ ID NO:554) region of the p450 gene or reverse primers to either the plasmid or poly A tail. All sequencing was performed at least twice in both directions.

The nucleic acid sequences of cytochrome p450 fragments were compared to each other from the coding region corresponding to the first nucleic acid after the region encoding the GRRXCP(A/G) (SEQ ID NO:554) motif through to the stop codon. This region was selected as an indicator of genetic diversity among p450 proteins. A large number of genetically distinct p450 genes, in excess of 70 genes, were observed, similar to that of other plant species. Upon comparison of nucleic acid sequences, it was found that the genes could be placed into distinct sequences groups based on their sequence identity. It was found that the best unique grouping of p450 members was determined to be those sequences with 75% nucleic acid identity or greater (shown in Table I). Reducing the percentage identity resulted in significantly larger groups. A preferred grouping was observed for those sequences with 81% nucleic acid identity or greater, a more preferred grouping 91% nucleic acid identity or greater, and a most preferred grouping for those sequences 99% nucleic acid identity of greater. Most of the groups contained at least two members and frequently three or more members. Others were not repeatedly discovered suggesting that approach taken was able to isolated both low and high expressing mRNA in the tissue used.

Based on 75% nucleic acid identity or greater, two cytochrome p450 groups were found to contain nucleic acid sequence identity to previously tobacco cytochrome genes that genetically distinct from that within the group. Group 23, showed nucleic acid identity, within the parameters used for Table I, to prior GenBank sequences of GI:1171579 (CAA64635) (SEQ ID NO:562) and GI:14423327 (or AAK62346) (SEQ ID NO:563) by Czernic et al and Ralston et al, respectively. GI:1171579 had nucleic acid identity to Group 23 members ranging 96.9% to 99.5% identity to members of Group 23 while GI:14423327 ranged 95.4% to 96.9% identity to this group. The members of Group 31 had nucleic acid identity ranging from 76.7% to 97.8% identity to the GenBank reported sequence of GI:14423319 (AAK62342) (SEQ ID NO:564) by Ralston et al. None of the other p450 identity groups of Table 1 contained parameter identity, as used in Table 1, to *Nicotiana* p450s genes reported by Ralston et al, Czernic et al., Wang et al or LaRosa and Smigocki.

A consensus sequence with appropriate nucleic acid degenerate probes could be derived for a group to preferentially identify and isolate additional members of each group from *Nicotiana* plants.

TABLE I

Nicotiana p450 Nucleic Acid Sequence Identity Groups

| GROUP | FRAGMENTS |
|---|---|
| 1 | D58-BG7 (SEQ ID No.: 1), D58-AB1 (SEQ ID No.: 3); D58-BE4 (SEQ ID No.: 7) |
| 2 | D56-AH7 (SEQ ID No.: 9); D13a-5 (SEQ ID No.: 11) |
| 3 | D56-AG10 (SEQ ID No.: 13); D35-33 (SEQ ID No.: 15); D34-62 (SEQ ID No.: 17) |
| 4 | D56-AA7 (SEQ ID No.: 19); D56-AE1 (SEQ ID No.: 21); 185-BD3 (SEQ ID No.: 143) |
| 5 | D35-BB7 (SEQ ID No.: 23); D177-BA7 (SEQ ID No.: 25); D56A-AB6 (SEQ ID No.: 27); D144-AE2 (SEQ ID No.: 29) |
| 6 | D56-AG11 (SEQ ID No.: 31); D179-AA1 (SEQ ID No.: 33) |
| 7 | D56-AC7 (SEQ ID No.: 35); D144-AD1 (SEQ ID No.: 37) |
| 8 | D144-AB5 (SEQ ID No.: 39) |
| 9 | D181-AB5 (SEQ ID No.: 41); D73-Ac9 (SEQ ID No.: 43) |
| 10 | D56-AC12 (SEQ ID No.: 45) |
| 11 | D58-AB9 (SEQ ID No.: 47); D56-AG9 (SEQ ID No.: 49); D56-AG6 (SEQ ID No.: 51); D35-BG11 (SEQ ID No.: 53); D35-42 (SEQ ID No.: 55); D35-BA3 (SEQ ID No.: 57); D34-57 (SEQ ID No.: 59); D34-52 (SEQ ID No.: 61); D34-25 (SEQ ID No.: 63) |
| 12 | D56-AD10 (SEQ ID No.: 65) |
| 13 | 56-AA11 (SEQ ID No.: 67) |
| 14 | D177-BD5 (SEQ ID No.: 69); D177-BD7 (SEQ ID No.: 83) |
| 15 | D56A-AG10 (SEQ ID No.: 71); D58-BC5 (SEQ ID No.: 73); D58-AD12 (SEQ ID No.: 75) |
| 16 | D56-AC11 (SEQ ID No.: 77); D35-39 (SEQ ID No.: 79); D58-BH4 (SEQ ID No.: 81); D56-AD6 (SEQ ID No.: 87) |
| 17 | D73A-AD6 (SEQ ID No.: 89); D70A-BA11 (SEQ ID No.: 91) |
| 18 | D70A-AB5 (SEQ ID No.: 95); D70A-AA8 (SEQ ID No.: 97) |
| 19 | D70A-AB8 (SEQ ID No.: 99); D70A-BH2 (SEQ ID No.: 101); D70A-AA4 (SEQ ID No.: 103) |
| 20 | D70A-BA1 (SEQ ID No.: 105); D70A-BA9 (SEQ ID No.: 107) |
| 21 | D70A-BD4 (SEQ ID No.: 109) |
| 22 | D181-AC5 (SEQ ID No.: 111); D144-AH1 (SEQ ID No.: 113); D34-65 (SEQ ID No.: 115) |
| 23 | D35-BG2 (SEQ ID No.: 117) |
| 24 | D73A-AH7 (SEQ ID No.: 119) |
| 25 | D58-AA1 (SEQ ID No.: 121); D185-BC1 (SEQ ID No.: 133); D185-BG2 (SEQ ID No.: 135) |
| 26 | D73-AE10 (SEQ ID No.: 123) |
| 27 | D56-AC12 (SEQ ID No.: 125) |
| 28 | D177-BF7 (SEQ ID No.: 127); D185-BE1 (SEQ ID No.: 137); D185-BD2 (SEQ ID No.: 139) |
| 29 | D73A-AG3 (SEQ ID No.: 129) |
| 30 | D70A-AA12 (SEQ ID No.: 131); D176-BF2 (SEQ ID No.: 85) |
| 31 | D176-BC3 (SEQ ID No.: 145) |
| 32 | D176-BB3 (SEQ ID No.: 147) |
| 33 | D186-AH4 (SEQ ID No.: 5) |

Example 10

Related Amino Acid Sequence Identity of Isolated Nucleic Acid Fragments

The amino acid sequences of nucleic acid sequences obtained for cytochrome p450 fragments from Example 8 were deduced. The deduced region corresponded to the amino acid immediately after the GXRXCP(A/G) (SEQ ID NO:555) sequence motif to the end of the carboxyl-terminus, or stop codon. Upon comparison of sequence identity of the fragments, a unique grouping was observed for those sequences with 70% amino acid identity or greater. A preferred grouping was observed for those sequences with 80% amino acid identity or greater, more preferred with 90% amino acid identity or greater, and a most preferred grouping for those sequences 99% amino acid identity of greater. The groups and corresponding amino acid sequences of group members are shown in FIG. 1. Several of the unique nucleic acid sequences were found to have complete amino acid identity to other fragments and therefore only one member with the identical amino acid was reported.

The amino acid identity for Group 19 of Table II corresponded to three distinct groups based on their nucleic acid sequences. The amino acid sequences of each group member and their identity is shown in FIG. 2. The amino acid differences are appropriately marked.

At least one member of each amino acid identity group was selected for gene cloning and functional studies using plants. In addition, group members that are differentially affected by ethylene treatment or other biological differences as assessed by Northern and Southern analysis were selected for gene cloning and functional studies. To assist in gene cloning, expression studies and whole plant evaluations, peptide specific antibodies will be prepared on sequence identity and differential sequence.

TABLE II

Nicotiana p450 Amino Acid Sequence Identity Groups

| GROUP | FRAGMENTS |
|---|---|
| 1 | D58-BG7 (SEQ ID No.: 2), D58-AB1 (SEQ ID No.: 4) |
| 2 | D58-BE4 (SEQ ID No.: 8) |
| 3 | D56-AH7 (SEQ ID No.: 10); D13a-5 (SEQ ID No.: 12) |
| 4 | D56-AG10 (SEQ ID No.: 14); D34-62 (SEQ ID No.: 18) |
| 5 | D56-AA7 (SEQ ID No.: 20); D56-AE1 (SEQ ID No.: 22); 185-BD3 (SEQ ID No.: 144) |
| 6 | D35-BB7 (SEQ ID No.: 24); D177-BA7 (SEQ ID No.: 26); D56A-AB6 (SEQ ID No.: 28); D144-AE2 (SEQ ID No.: 30) |
| 7 | D56-AG11 (SEQ ID No.: 32); D179-AA1 (SEQ ID No.: 34) |
| 8 | D56-AC7 (SEQ ID No.: 36); D144-AD1 (SEQ ID No.: 38) |
| 9 | D144-AB5 (SEQ ID No.: 40) |
| 10 | D181-AB5 (SEQ ID No.: 42); D73-Ac9 (SEQ ID No.: 44) |
| 11 | D56-AC12 (SEQ ID No.: 46) |
| 12 | D58-AB9 (SEQ ID No.: 48); D56-AG9 (SEQ ID No.: 50); D56-AG6 (SEQ ID No.: 52); D35-BG11 (SEQ ID No.: 54); D35-42 (SEQ ID No.: 56); D35-BA3 (SEQ ID No.: 58); D34-57 (SEQ ID No.: 60); D34-52 (SEQ ID No.: 62) |
| 13 | D56AD10 (SEQ ID No.: 66) |
| 14 | 56-AA11 (SEQ ID No.: 68) |
| 15 | D177-BD5 (SEQ ID No.: 70); D177-BD7 (SEQ ID No.: 84) |
| 16 | D56A-AG10 (SEQ ID No.: 72); D58-BC5 (SEQ ID No.: 74); D58-AD12 (SEQ ID No.: 76) |
| 17 | D56-AC11 (SEQ ID No.: 78); D56-AD6 (SEQ ID No.: 88) |
| 18 | D73A-AD6 (SEQ ID No. 90:) |
| 19 | D70A-AB5 (SEQ ID No.: 96); D70A-AB8 (SEQ ID No.: 100); D70A-BH2 (SEQ ID No.: 102); D70A-AA4 (SEQ ID No.: 104); D70A-BA1 (SEQ ID No.: 106); D70A-BA9 (SEQ ID No.: 108) |
| 20 | D70A-BD4 (SEQ ID No.: 110) |
| 21 | D181-AC5 (SEQ ID No.: 112); D144-AH1 (SEQ ID No.: 114); D34-65 (SEQ ID No.: 116) |
| 22 | D35-BG2 (SEQ ID No.: 118) |
| 23 | D73A-AH7 (SEQ ID No.: 120) |
| 24 | D58-AA1 (SEQ ID No.: 122); D185-BC1 (SEQ ID No.: 134); D185-BG2 (SEQ ID No.: 136) |
| 25 | D73-AE10 (SEQ ID No.: 124) |
| 26 | D56-AC12 (SEQ ID No.: 126) |
| 27 | D177-BF7 (SEQ ID No.: 128); 185-BD2 (SEQ ID No.: 140) |
| 28 | D73A-AG3 (SEQ ID No.: 130) |
| 29 | D70A-AA12 (SEQ ID No.: 132); D176-BF2 (SEQ ID No.: 86) |
| 30 | D176-BC3 (SEQ ID No.: 146) |
| 31 | D176-BB3 (SEQ ID No.: 148) |
| 32 | D186-AH4 (SEQ ID No.: 6) |

Example 11

Related Amino Acid Sequence Identity of Full Length Clones

The nucleic acid sequence of full length *Nicotiana* genes cloned in Example 5 were deduced for their entire amino acid sequence. Cytochrome p450 genes were identified by the presence of three conserved p450 domain motifs, which corresponded to UXXRXXZ (SEQ ID NO:569), PXRFXF (SEQ ID NO:556) or GXRXC (SEQ ID NO:557) at the carboxyl-terminus where U is E or K, X is any amino acid and Z is P, T, S or M. It was also noted that two of the clones appeared nearly complete but lacked the appropriate stop codon, D140-AA1 and D101-BA2, but both contained all three p450 cytochrome domains. All p450 genes were characterized for amino acid identity using a BLAST program comparing their full length sequences to each other and to known tobacco genes. The program used the NCBI special BLAST tool (Align two sequences (bl2seq), ncbi.nlm.nih.gov/blast/b12seq/b12.html) on the World Wide Web. Two sequences were aligned under BLASTN without filter for nucleic acid sequences and BLASTP for amino acid sequences. Based on their percentage amino acid identity, each sequence as grouped into identity groups where the grouping contained members that shared at least 85% identity with another member. A preferred grouping was observed for those sequences with 90% amino acid identity or greater, a more preferred grouping had 95% amino acid identity or greater, and a most preferred grouping had those sequences 99% amino acid identity or greater. Using these criteria, 25 unique groups were identified and are depicted in Table III.

Within the parameters used for Table III for amino acid identity, three groups were found to contain greater than 85% or greater identity to known tobacco genes. Members of Group 5 had up to 96% amino acid identity for full length sequences to prior GenBank sequences of GI:14423327 (or AAK62346) (SEQ ID NO:563) by Ralston et al. Group 23 had up to 93% amino acid identity to GI:14423328 (or AAK62347) (SEQ ID NO:565) by Ralston et al. and Group 24 had 92% identity to GI:14423318 (SEQ ID NO:564) (or AAK62343) (SEQ ID NO:566) by Ralston et al.

TABLE III

Amino Acid Sequence Identity Groups of Full Length Nicotiana p450 Genes

| | |
|---|---|
| 1 | D208-AD9 (SEQ. ID. No. 224); D120-AH4 (SEQ. ID. No. 180); D121-AA8 (SEQ. ID. No. 182), D122-AF10 (SEQ. ID. No. 184); D103-AH3 (SEQ. ID. No. 222); D208-AC8 (SEQ. ID. No. 218); D-235-AB1 (SEQ. ID. No. 246) |
| 2 | D244-AD4 (SEQ. ID. No. 250); D244-AB6 (SEQ. ID. No. 274); D285-AA8; D285-AB9; D268-AE2 (SEQ. ID. No. 270) |
| 3 | D100A-AC3 (SEQ. ID. No. 168); D100A-BE2 |
| 4 | D205-BE9 (SEQ. ID. No. 276); D205-BG9 (SEQ. ID. No. 202); D205-AH4 (SEQ. ID. No. 294) |
| 5 | D259-AB9 (SEQ. ID. No. 260); D257-AE4 (SEQ. ID. No. 268); D147-AD3 (SEQ. ID. No. 194) |
| 6 | D249-AE8 (SEQ. ID. No. 256); D-248-AA6 (SEQ. ID. No. 254) |
| 7 | D233-AG7 (SEQ. ID. No. 266; D224-BD11 (SEQ. ID. No. 240); DAF10 |
| 8 | D105-AD6 (SEQ. ID. No. 172); D215-AB5 (SEQ. ID. No. 220); D135-AE1 (SEQ. ID. No. 190) |
| 9 | D87A-AF3 (SEQ. ID. No. 216), D210-BD4 (SEQ. ID. No. 262) |
| 10 | D89-AB1 (SEQ. ID. No. 150); D89-AD2 (SEQ. ID. No. 152); 163-AG11 (SEQ. ID. No. 198); 163-AF12 (SEQ. ID. No. 196) |
| 11 | D267-AF10 (SEQ. ID. No. 296); D96-AC2 (SEQ. ID. No. 160); D96-AB6 (SEQ. ID. No. 158); D207-AA5 (SEQ. ID. NO. 204); D207-AB4 (SEQ. ID. No. 206); D207-AC4 (SEQ. ID. No. 208) |
| 12 | D98-AG1 (SEQ. ID. No. 164); D98-AA1 (SEQ. ID. No. 162) |

TABLE III-continued

Amino Acid Sequence Identity Groups
of Full Length Nicotiana p450 Genes

| | |
|---|---|
| 13 | D209-AA12 (SEQ. ID. No. 212); D209-AA11; D209-AH10 (SEQ. ID. No. 214); D209-AH12 (SEQ. ID. No. 232); D90a-BB3 (SEQ. ID. No. 154) |
| 14 | D129-AD10 (SEQ. ID. No. 188); D104A-AE8 (SEQ. ID. No. 170) |
| 15 | D228-AH8 (SEQ. ID. No. 244); D228-AD7 (SEQ. ID. No. 241), D250-AC11 (SEQ. ID. No. 258); D247-AH1 (SEQ. ID. No. 252) |
| 16 | D128-AB7 (SEQ. ID. No. 186); D243-AA2 (SEQ. ID. No. 248); D125-AF11 (SEQ. ID. No. 228) |
| 17 | D284-AH5 (SEQ. ID. No. 298); D110-AF12 (SEQ. ID. No. 176) |
| 18 | D221-BB8 (SEQ. ID. No. 234) |
| 19 | D222-BH4 (SEQ. ID. No. 236) |
| 20 | D134-AE11 (SEQ. ID. No. 230) |
| 21 | D109-AH8 (SEQ. ID. No. 174) |
| 22 | D136-AF4 (SEQ. ID. No. 278) |
| 23 | D237-AD1 (SEQ. ID. No. 226) |
| 24 | D112-AA5 (SEQ. ID. No. 178) |
| 25 | D283-AC1 (SEQ. ID. No. 272) |

The full length genes were further grouped based on the highly conversed amino acid homology between UXXRXXZ p450 domain (SEQ ID NO:569) and GXRXC p450 domain (SEQ ID NO:557) near the end the carboxyl-terminus. As shown in FIG. 3, individual clones were aligned for their sequence homology between the conserved domains relative to each other and placed in distinct identity groups. In several cases, although the nucleic acid sequence of the clone was unique, the amino acid sequence for the region was identical. The preferred grouping was observed for those sequences with 90% amino acid identity or greater, a more preferred group had 95% amino acid identity or greater, and a most preferred grouping had those sequences 99% amino acid identity of greater. The final grouping was similar to that based on the percent identity for the entire amino acid sequence of the clones except for Group 17 (of Table III) which was divided into two distinct groups.

Within the parameters used for amino acid identity in Table IV, three groups were found to contain 90% or greater identity to known tobacco genes. Members of Group 5 had up to 93.4% amino acid identity for full length sequences to prior GenBank sequences of GI:14423326 (AAK62346) (SEQ ID NO:563) by Ralston et al. Group 23 had up to 91.8% amino acid identity to GI:14423328 (or AAK62347) (SEQ ID NO:565) by Ralston et al. and Group 24 had 98.8% identity to GI:14423318 (or AAK62342) (SEQ ID NO:564) by Ralston et al.

TABLE IV

Amino Acid Sequence Identity Groups of Regions between
Conserved Domains of Nicotiana p450 Genes

| | |
|---|---|
| 1 1 | D208-AD9 (SEQ. ID. No. 224); D120-AH4 (SEQ. ID. No. 180); D121-AA8 (SEQ. ID. No. 182), D122-AF10 (SEQ. ID. No. 184); D103-AH3 (SEQ. ID. No. 222); D208-AC8 (SEQ. ID. No. 218); D-235-ABI (SEQ. ID. No. 246) |
| 2 | D244-AD4 (SEQ. ID. No. 250); D244-AB6 (SEQ. ID. No. 274); D285-AA8; D285-AB9; D268-AE2 (SEQ. ID. No. 270) |
| 3 | D100A-AC3 (SEQ. ID. No. 168); D100A-BE2 |
| 4 | D205-BE9 (SEQ. ID. No. 276); D205-BG9 (SEQ. ID. No. 202); D205-AH4 (SEQ. ID. No. 294) |
| 5 | D259-AB9 (SEQ. ID. No. 260); D257-AE4 (SEQ. ID. No. 268); D147-AD3 (SEQ. ID. No. 194) |
| 6 | D249-AE8 (SEQ. ID. No. 256); D-248-AA6 (SEQ. ID. No. 254) |
| 7 | D233-AG7 (SEQ. ID. No. 266); D224-BD11 (SEQ. ID. No. 240); DAF10 |
| 8 | D105-AD6 (SEQ. ID. No. 172); D215-AB5 (SEQ. ID. No. 220); D135-AE1 (SEQ. ID. No. 190) |

TABLE IV-continued

Amino Acid Sequence Identity Groups of Regions between
Conserved Domains of Nicotiana p450 Genes

| | |
|---|---|
| 9 | D87A-AF3 (SEQ. ID. No. 216), D210-BD4 (SEQ. ID. No. 262) |
| 10 | D89-AB1 (SEQ. ID. No. 150); D89-AD2 (SEQ. ID. No. 152); 163-AG11 (SEQ. ID. No. 198); 163-AF12 (SEQ. ID. No. 196) |
| 11 | D267-AF10 (SEQ. ID. No. 296); D96-AC2 (SEQ. ID. No. 160); D96-AB6 (SEQ. ID. No. 158); D207-AA5 (SEQ. ID. No. 204); D207-AB4 (SEQ. ID. No. 206); D207-AC4 (SEQ. ID. No. 208) |
| 12 | D98-AG1 (SEQ. ID. No. 164); D98-AA1 (SEQ. ID. No. 162) |
| 13 | D209-AA12 (SEQ. ID. No. 212); D209-AA11; D209-AH10 (SEQ. ID. No. 214); D209-AH12 (SEQ. ID. No. 232); D90a-BB3 (SEQ. ID. No. 154) |
| 14 | D129-AD10 (SEQ. ID. No. 188); D104A-AE8 (SEQ. ID. No. 170) |
| 15 | D228-AH8 (SEQ. ID. No. 244); D228-AD7 (SEQ. ID. No. 241), D250-AC11 (SEQ. ID. No. 258); D247-AH1 (SEQ. ID. No. 252) |
| 16 | D128-AB7 (SEQ. ID. No. 186); D243-AA2 (SEQ. ID. No. 248); D125-AF11 (SEQ. ID. No. 228) |
| 17 | D284-AH5 (SEQ. ID. No. 298); D110-AF12 (SEQ. ID. No. 176) |
| 18 | D221-BB8 (SEQ. ID. No. 234) |
| 19 | D222-BH4 (SEQ. ID. No. 236) |
| 20 | D134-AE11 (SEQ. ID. No. 230) |
| 21 | D109-AH8 (SEQ. ID. No. 174) |
| 22 | D136-AF4 (SEQ. ID. No. 278) |
| 23 | D237-AD1 (SEQ. ID. No. 226) |
| 24 | D112-AA5 (SEQ. ID. No. 178) |
| 25 | D283-AC1 (SEQ. ID. No. 272) |
| 26 | D110-AF12 (SEQ. ID. No. 176) |

Example 12

Nicotiana Cytochrome P450 Clones Lacking One or More of the Tobacco Cytochrome P450 Specific Domains Four clones had high nucleic acid homology, ranging 90% to 99% nucleic acid homology, to other tobacco cytochrome genes reported in Table III. The four clones included D136-AD5, D138-AD12, D243-AB3 and D250-AC11. However, due to a nucleotide frameshift these genes did not contain one or more of three C-terminus cytochrome p450 domains and were excluded from identity groups presented in Table III or Table IV.

The amino acid identity of one clone, D95-AG1, did not contain the third domain, GXRXC (SEQ ID NO:557), used to group p450 tobacco genes in Table III or Table IV. The nucleic acid homology of this clone had low homology to other tobacco cytochrome genes. This clone represents a novel and different group of cytochrome p450 genes in Nicotiana.

Example 13

Use of Nicotiana Cytochrome P450 Fragments and Clones in Altered Regulation of Tobacco Properties The use of tobacco p450 nucleic acid fragments or whole genes are useful in identifying and selecting those plants that have altered tobacco phenotypes or tobacco constituents and, more importantly, altered metabolites. Transgenic tobacco plants are generated by a variety of transformation systems that incorporate nucleic acid fragments or full length genes, selected from those reported herein, in orientations for either down-regulation, for example anti-sense orientation, or over-expression for example, sense orientation. For over-expression to full length genes, any nucleic acid sequence that encodes the entire or a functional part or amino acide sequence of the full-length genes described in this invention are desired that are effective for increasing the expression of a certain enzyme and thus resulting in phenotypic effect within *Nicotiana*. *Nicotiana* lines that are homozygous lines are obtained through a series of backcrossing and assessed for phenotypic changes including, but not limited to, analysis of endogenous p450 RNA, transcripts, p450 expressed peptides and concentrations of plant metabolites using techniques commonly available to one having ordinary skill in the art. The changes exhibited in the tobacco plans provide information on the functional role of the selected gene of interest or are of a utility as a preferred *Nicotiana* plant species.

Example 14

Identification of Genes Induced in Ethylene Treated Converter Lines

High density oligonucleotide array technology, Affymetrix GeneChip® (Affymetrix Inc., Santa Clara, Calif.) array, was used for quantitative and highly parallel measurements of gene expression. In using this technology, nucleic acid arrays were fabricated by direct synthesis of oligonucleotides on a solid surface. This solid-phase chemistry is able to produce arrays containing hundreds of thousands of oligonucleotide probes packed at extremely high densities on a chip referred to as GeneChip®. Thousands of genes can be simultaneously screened from a single hybridization. Each gene is typically represented by a set of 11-25 pairs of probes depending upon size. The probes are designed to maximize sensitivity, specificity, and reproducibility, allowing consistent discrimination between specific and background signals, and between closely related target sequences.

Affymetrix GeneChip hybridization experiments involve the following steps: design and production of arrays, preparation of fluorescently labeled target from RNA isolated from the biological specimens, hybridization of the labeled target to the GeneChip, screening the array, and analysis of the scanned image and generation of gene expression profiles.

A. Designing and Custom Making Affymetrix GeneChip

A GeneChip CustomExpress Advantage Array was custom made by Affymetrix Inc. (Santa Clara, Calif.). Chip size was 18 micron and array format was 100-2187 that can accommodate 528 probe sets (11, 628 probes). Except for GenBank derived nucleic acid sequences, all sequences were selected from our previously identified tobacco clones and all probes were custom designed. A total of 400 tobacco genes or fragments were selected to be included on the GeneChip. The sequences of oligonucleotides selected were based on unique regions of the 3' end of the gene. The selected nucleic acid sequences consisted of 56 full length p450 genes and 71 p450 fragments that were cloned from tobacco, described in (patent applications). Other tobacco sequences included 270 tobacco ESTs which were generated from suppression subtraction library using Clontech SSH kit(BD Biosciences, Palo Alto, Calif.). Among these genes, some oligonucleotide sequences were selected from cytochrome P450 genes listed in GenBank. Up to 25 probes were used for each full length gene and 11 probes for each fragment. A reduced number of probes were used for some clones due to the lack of unique, high quality probes. Appropriate control sequences were also included on the GeneChip®.

The probe Arrays were 25-mer oligonucleotides that were directly synthesized onto a glass wafer by a combination of semiconductor-based photolithography and solid phase chemical synthesis technologies. Each array contained up to 100,000 different oligonucleotide probes. Since oligonucleotide probes are synthesized in known locations on the array, the hybridization patterns and signal intensities can be interpreted in terms of gene identity and relative expression levels by the Affymetrix Microarray Suite® software. Each probe pair consists of a perfect match oligonucleotide and a mismatch oligonucleotide. The perfect match probe has a sequence exactly complimentary to the particular gene and thus measures the expression of the gene. The mismatch probe differs from the perfect match probe by a single base substitution at the center base position, which disturbs the binding of the target gene transcript. The mismatch produces a nonspecific hybridization signal or background signal that was compared to the signal measured for the perfect match oligonucleotide.

B. Sample Preparation

Hybridization experiments were conducted by Genome Explorations, Inc. (Memphis, Tenn.). The RNA samples used in hybridization consisted of six pairs of nonconverter/converter isogenic lines that were induced by ethylene treatments. Samples included one pair of 4407-25/4407-33 non-treated burly tobacco samples, three pairs of ethylene treated 4407-25/4407-samples, one pair of ethylene treated dark tobacco NL Madole/181 and one pair of ethylene treated burly variety PBLB01/178. Ethylene treatment was as described in Example 1.

Total RNA was extracted from above mentioned ethylene treated and non-treated leaves using a modified acid phenol and chloroform extraction protocol. Protocol was modified to use one gram of tissue that was ground and subsequently vortexed in 5 ml of extraction buffer (100 mM Tris-HCl, pH 8.5; 200 mM NaCl; 10 mM EDTA; 0.5% SDS) to which 5 ml phenol (pH5.5) and 5 ml chloroform was added. The extracted sample was centrifuged and the supernatant was saved. This extraction step was repeated 2-3 more times until the supernatant appeared clear. Approximately 5 ml of chloroform was added to remove trace amounts of phenol. RNA was precipitated from the combined supernatant fractions by adding a 3-fold volume of ETOH and 1/10 volume of 3M NaOAc (pH5.2) and storing at −20° C. for 1 hour. After transferring to a Corex glass container the RNA fraction was centrifuged at 9,000 RPM for 45 minutes at 4° C. The pellet was washed with 70% ethanol and spun for 5 minutes at 9,000 RPM at 4° C. After drying the pellet, the pelleted RNA was dissolved in 0.5 ml RNase free water. The pelleted RNA was dissolved in 0.5 ml RNase free water. The quality and quantity of total RNA was analyzed by denatured formaldehyde gel and spectrophotometer, respectively. The total RNA samples with 3-5 μg/ul were sent to Genome explorations, inc. to do the hybridization.

C. Hybridization, Detection and Data Output

The preparation of labeled cRNA material was performed as follows. First and second strand cDNA were synthesized from 5-15 μg of total RNA using the SuperScript Double-Stranded cDNA Synthesis Kit (Gibco Life Technologies) and oligo-dT24-T7 (5'-GGC CAG TGA ATT GTA ATA CGA CTC ACT ATA GGG AGG CGG-3') primer (SEQ ID NO:558) according to the manufacturer's instructions.

The cRNA was concurrently synthesized and labeled with biotinylated UTP and CTP by in vitro transcription using the T7 promoter coupled double stranded cDNA as template and the T7 RNA Transcript Labeling Kit (ENZO Diagnostics Inc.). Briefly, double stranded cDNA synthesized from the previous steps were washed twice with 70% ethanol and resuspended in 22 μl Rnase-free H2O. The cDNA was incubated with 4 μl of 10× each Reaction Buffer, Biotin Labeled Ribonucleotides, DTT, Rnase Inhibitor Mix and 2 μl 20×T7 RNA Polymerase for 5 hr at 37° C. The labeled cRNA was separated from unincorporated ribonucleotides by passing through a CHROMA SPIN-100 column (Clontech) and precipitated at −20° C. for 1 hr to overnight.

Oligonucleotide array hybridization and analysis were performed as follows. The cRNA pellet was resuspended in 10 µl Rnase-free H2O and 10.0 µg was fragmented by heat and ion-mediated hydrolysis at 95° C. for 35 mins in 200 mM Tris-acetate, pH 8.1, 500 mM KOAc, 150 mM MgOAc. The fragmented cRNA was hybridized for 16 hr at 45° C. to HG_U95Av2 oligonucleotide arrays (Affymetrix) containing ~12,500 full length annotated genes together with additional probe sets designed to represent EST sequences. Arrays were washed at 25° C. with 6×SSPE (0.9M NaCl, 60 mMNaH2PO4, 6 mM EDTA+0.01% Tween 20) followed by a stringent wash at 50° C. with 100 mM MES, 0.1M [Na+], 0.01% Tween 20. The arrays were stained with phycoerythrein conjugated streptavidin (Molecular Probes) and the fluorescence intensities were determined using a laser confocal scanner (Hewlett-Packard). The scanned images were analyzed using Microarray software (Affymetrix). Sample loading and variations in staining were standardized by scaling the average of the fluorescent intensities of all genes on an array to constant target intensity (250) for all arrays used. Data Analysis was conducted using Microarray Suite 5.0 (Affymetrix) following user guidelines. The signal intensity for each gene was calculated as the average intensity difference, represented by [Σ(PM−MM)/(number of probe pairs)], where PM and MM denote perfect-match and mismatch probes.

D. Data Analysis and Results

Twelve sets of hybridizations were successful as evidenced by the Expression Report generated using detection instruments from Genome Explorations. The main parameters on the report included Noise, Scale factor, background, total probe sets, number and percentage of present and absent probe sets, signal intensity of housekeeping controls. The data was subsequently analyzed and presented using software GCOS in combination of other Microsoft software. Signal comparison between treatment pairs was analyzed. Overall data for all respective probes corresponding to genes and fragments of each different treatment including replications were compiled and compiled expression data such as call of the changes and signal log 2 ratio changes were analyzed.

A typical application of GeneChip technology is finding genes that are differentially expressed in different tissues. In the present application, genetic expression variations caused by ethylene treatment were determined for pairs of converter and nonconverter tobacco lines that included a 4407-25/4407-33 burley variety, PBLB01/178 burley variety, and a NL Madole/181 dark variety. These analyses detected only those genes whose expression is significantly altered due to biological variation. These analyses employed the Fold change (signal ratio) as a major criterion to identify induced genes. Other parameters, such as signal intensity, present/absent call, were also taken into consideration.

After analyzing the data for expression differences in converter and nonconverter pairs of samples for approximately 400 genes, the results based on the signal intensities showed that only two genes, D121-AA8 and D120-AH4, had reproducible induction in ethylene treated converter lines versus non-converter lines. To illustrate the differential expression of these genes, the data was represented as follows. As shown in Table V, the signal of a gene in a converter line, for example, burley tobacco variety, 4407-33, was determined as ratio to the signal of a related nonconverter isogenic line, 4407-25. Without ethylene treatment, the ratio of converter to nonconverter signals for all genes approached 1.00. Upon ethylene treatment, two genes, D121-AA8 and D120-AH4, were induced in converter lines relative to non-converter line as determined by three independent analyses using isogenic burley lines. These genes have very high homology to each other, approximately 99.8% or greater nucleic acid sequence homology. As depicted in Table V, their relative hybridization signals in converter varieties ranged from approximately 2 to 12 fold higher in converter lines than the signals in their non-converter counterparts. In comparison, two actin-like control clones, internal controls, were found not to be induced in converter lines based on their normalized ratios. In addition, a fragment (D35-BG11), whose sequence in coding region is entirely contained in both D121-AA8 and D120-AH4 genes, was highly induced in the same samples of paired isogenic converter and nonconverter lines. Another isogenic pair of burley tobacco varieties, PBLB01 and 178, was shown to have the same genes, D121-AA8 and D120-AH4, induced in converter samples under ethylene induction. Furthermore, D121-AA8 and D120-AH4 genes were preferentially induced in converter lines of isogenic dark tobacco pairs, NL Madole and 181, demonstrating that ethylene induction of these genes in converter lines was not limited to burley tobacco varieties. In all cases, the D35-BG11 fragment was the most highly induced in converter relative to nonconverter paired lines.

TABLE V

A Comparison of Clone Induction in Ethylene Treated Converter and Non-Converter Lines

| Clones | No Treatment | Ethylene Treated Burley Exp 1 | | Ethylene Treated Burley Exp 2 | | Ethylene Treated Burley Exp 3 | | Ethylene Treated Dark | |
|---|---|---|---|---|---|---|---|---|---|
| | 33:25 Ratio | 33:25 Ratio | Et:No Ratio | 33:25 Ratio | Et:No Ratio | 33:25 Ratio | Et:No Ratio | 181:NL Ratio | Et:No Ratio |
| Induced | | | | | | | | | |
| D121-AA8 | 1.03 | 2.20 | 2.14 | 13.25 | 12.90 | 5.31 | 5.15 | 17.06 | 16.60 |
| D120-AH4 | 1.44 | 2.74 | 1.90 | 18.33 | 12.74 | 4.13 | 2.87 | 11.76 | 8.17 |
| Control | | | | | | | | | |
| Actin-Like I | 1.18 | 1.17 | 0.99 | 0.88 | 0.74 | 0.86 | 0.73 | 1.20 | 1.02 |
| Actin-Like I | 1.09 | 1.23 | 1.12 | 0.89 | 0.81 | 1.18 | 0.11 | 1.02 | 0.93 |

Example 15

Cloning Related D35-Bg11 Full Length Genes

GeneChip hybridization was based on 3' reverse transcription (cRNA). The probes were synthesized on GeneChip were chosen from the 3' end of the genes (in the downstream 1000 nucleotide region). Therefore, in order to obtain all the possible variations of D121-AA8 and D120-AH4 clones, additional cloning was performed from the tobacco cDNA library using 5' sequences.

The full length genes were cloned from cDNA library constructed from 4407-33 ethylene treated tissue as described in Example 5. The Polymerase Chain Reaction method was used as follows. The reverse primers were designed based on the 3' sequence (including part of untranslated region) the D121-AA8 gene. The primer of D121-p2 5'-AGC AAG ATG ATC TTA GGT TTT AA-3' (SEQ ID NO:559) and D121-R-2 5'-CAA GCA AGA TGA TCT TAG GTT TTA ATA AAG CTC AGG T-3' (SEQ ID NO:560). The T3 primer (5' CAA TTA ACC CTC ACT AAA GGG 3') (SEQ ID NO:561), located upstream of the inserts in the plasmid, was used as forward primer The generated PCR products were subjected to agarose electrophoresis and the corresponding bands of high molecular weight were excised, purified, cloned and sequenced. The methods for cloning and sequencing were described in Example 4. Nine novel clones were sequenced and identified as D425-AB10, D425-AB11, D425-AC9, D425-AC10, D425-AC11, D425-AG11, D425-AH7, D425-AH11, and D427-AA5. Each of the clones was observed to have 99% or greater nucleic acid sequence homology with clones D121-AA8 and D120-AH4.

Example 16

Ethylene Induction of Microsomal Nicotine Demethylase in Tobacco Converter Lines Biochemical analyses of demethylase enzymatic activity in microsomal enriched fractions of ethylene treated and non-treated pairs of converter and non-converter tobacco lines was performed as follows.

A. Preparation of Microsomes

Microsomes were isolated at 4° C. Tobacco leaves were extracted in a buffer consisting of 50 mM N-(2-hydrooxyethyl) piperazine-N'-(2-ethanesulfonic acid) (HEPES), pH 7.5, 3 mM DL-Dithiothreitol (DTT) and Protease Inhibitor Cocktail (Roche) at 1 tablet/50 ml. The crude extract was filtered through four layers of cheesecloth to remove undisrupted tissue, and the filtrate was centrifuged for 20 min at 20,000×g to remove cellular debris. The supernatant was subjected to ultracentrifugation at 100,000×g for 60 min and the resultant pellet contained the microsomal fraction. The microsomal fraction was suspended in the extraction buffer and applied to an ultracentrifugation step where a discontinuous sucrose gradient of 0.5 M sucrose in the extraction buffer was used. The purified microsomes were resuspended in the extraction buffer supplemented with 10% (w/v) glycerol as cryoprotectant. Microsomal preparations were stored in a liquid nitrogen freezer until use.

B. Protein Concentration Determination

Microsomal proteins were precipitated with 10% Trichloroacetic Acid (TCA) (w/v) in acetone, and the protein concentrations of microsomes were determined using RC DC Protein Assay Kit (BIO-RAD) following the manufacturer's protocol.

3. Nicotine Demethylase Activity Assay

DL-Nicotine (Pyrrolidine-2-$^{14}$C) was obtained from Moravek Biochemicals and had a specific activity of 54 mCi/mmol. Chlorpromazine (CPZ) and oxidized cytochrome c (cyt. C), both P450 inhibitors, were purchased from Sigma. Reduced form of nicotinamide adenine dinucleotide phosphate (NADPH) is the typical electron donor for cytochrome P450 via the NADPH:cytochrome P450 reductase. NADPH was omitted for control incubation. Routine enzyme assay consisted of microsomal proteins (around 2 mg/ml), 6 mM NADPH, 55 μM $^{14}$C labeled nicotine. The concentration of CPZ and Cyt. C, when used, was 1 mM and 100 μM, respectively. The reaction was carried at 25° C. for 1 hour and was stopped with addition of 300 μl methanol to each 25 μl reaction mixture. After spinning, 20 μl of the methanol extract was separated with a reverse-phase High Performance Liquid Chromatography (HPLC) system (Agilent) using an Inertsil ODS-3 3μ (150×4.6 mm) column from Varian. The isocratic mobile phase was the mixture of methanol and 50 mM potassium phosphate buffer, pH 6.25, with ratio of 60:40 (v/v) and the flow rate was 1 ml/min. The nornicotine peak, as determined by comparison with authentic non-labeled nornicotine, was collected and subjected to 2900 tri-carb Liquid Scintillation Counter (LSC) (Perkin Elmer) for quantification. The activity of nicotine demethylase is calculated based on the production of $^{14}$C labeled nornicotine over 1 hour incubation.

Samples were obtained from pairs of Burley converter (line 4407-33) and non-converter (line 4407-25) tobacco lines that were ethylene treated or not. All untreated samples did not have any detectable microsomal nicotine demethylase activity. In contrast, microsomal samples obtained from ethylene treated converter lines were found to contain significant levels of nicotine demethylase activity. The nicotine demethylase activity was shown to be inhibited by P450 specific inhibitors demonstrating the demethylase activity was consistent to a P450 microsomal derived enzyme. A typical set of enzyme assay results obtained for the burley converter tobacco line is shown in the Table VI. In contrast, sample derived from ethylene treated nonconverter tobacco did not contain any nicotine demethylase activity. These results demonstrated that nicotine demethylase activity was induced upon treatment with ethylene in converter lines but not in the corresponding isogenic nonconverter line. Similar results were obtained for an isogenic dark tobacco variety pair, where microsomal nicotine demethylase activity was induced in converter lines and not detectable in nonconverter paired lines. Together these experiments demonstrated that microsomal nicotine demethylase activity is induced upon ethylene treatment in converter lines while not in paired isogenic non-converter lines. Those genes that are P450 derived genes and are preferentially induced in converter lines relative to paired non-converter lines are candidate genes to encode the nicotine demethylase enzyme.

TABLE VI

DEMETHYLASE ACTIVITY IN MICROSOMES OF ETHYLENE INDUCED BURLEY CONVERTER AND NON CONVERTER LINES

| Sample | Microsomes | Microsomes + 1 mM chlorpromazine | Microsomes + with 100 μM cytochrome C | Microsomes − NADPH |
|---|---|---|---|---|
| Converter | 0.6 ± 0.05 pkat/mg | 0.01 ± 0.01 pkat/mg | 0.03 ± 0.05 pkat/mg | 0.03 ± 0.04 pkat/mg |
| Non-Converter | Not Detected | Not Detected | Not Detected | Not Detected |

SEQUENCE LISTING (569 sequences)

SEQ ID NO: 1 - DNA, 207 bp, Nicotiana tabacum
gcacaacttgctatcaacttggtcacatctatgttgggtcatttgttgcatcattttacatgggctccggccccgggggttaacccggaggatattgacttggaggagagccctggaacagtaacttacatgaaaaatccaatacaagctattccaactccaagattgcctgcacacttgtatggacgtgtgccagtggatatgtaa

SEQ ID NO: 2 - protein, 68 aa, Nicotiana tabacum
AQLAINLVTSMLGHLLHHFTWAPAPGVNPEDIDLEESPGTVTYMKNPIQAIPTPRLPAHLYGRVPVDM

SEQ ID NO: 3 - DNA, 207 bp, Nicotiana tabacum
gcacaacttgctatcaacttggtcacatctatgttgggtcatttgttgcatcattttacgtgggctccgcccccgggggttaacccggagaatattgacttggaggagagccctggaacagtaacttacatgaaaaatccaatacaagctattcctactccaagattgcctgcacacttgtatggacgtgtgccagtggatatgtaa

SEQ ID NO: 4 - protein, 68 aa, Nicotiana tabacum
AQLAINLVTSMLGHLLHHFTWAPPPGVNPENIDLEESPGTVTYMKNPIQAIPTPRLPAHLYGRVPVDM

SEQ ID NO: 5 - DNA, 183 bp, Nicotiana tabacum
atgaattattcattgcaagtggaacacctttcaattgctcatatgatccaaggtttcagttttgcaactacgaccaatgagcctttggatatgaaacaaggtgtgggtttaactttaccaaagaagactgatgttgaagtgctaattacacctcgccttcctcctacgctttatcaatattaa

SEQ ID NO: 6 - protein, 60 aa, Nicotiana tabacum
MNYSLQVEHLSIAHMIQGFSFATTTNEPLDMKQGVGLTLPKKTDVEVLITPRLPPTLYQY

SEQ ID NO: 7 - DNA, 132 bp, Nicotiana tabacum
gcacaacttgctatcaacttggtcacatctatgttgggtcatttgttcatcattttacatgggctccggccccgggggttaacccggaggatattgacttggaggagagccctggaacagtaacttacatga

SEQ ID NO: 8 - protein, 40 aa, Nicotiana tabacum
AQLAINLVTSMLGHLFIILHGLRPRGLTRRILTWRRALEQ

SEQ ID NO: 9 - DNA, 189 bp, Nicotiana tabacum
gaaggattggctgttcgaatggttgccttgtcattgggatgtattattcaatgttttgattggcaacgaatcggcgaagaattggttgatatgactgaaggaactggacttactttgcctaaagctcaacctttggtggccaagtgtagcccacgacctaaaatggctaatcttctctctcagatttga

SEQ ID NO: 10 - protein, 62 aa, Nicotiana tabacum
EGLAVRMVALSLGCIIQCFDWQRIGEELVDMTEGTGLTLPKAQPLVAKCSPRPKMANLLSQI

SEQ ID NO: 11 - DNA, 189 bp, Nicotiana tabacum
gaaggattggctattcgaatggttgcattgtcattgggatgtattattcaatgctttgattggcaacgacttggggaaggattggttgataagactgaaggaactggacttactttgcctaaagctcaacctttagtggccaagtgtagcccacgacctataatggctaatcttctttctcagatttga

SEQ ID NO: 12 - protein, 62 aa, Nicotiana tabacum
EGLAIRMVALSLGCIIQCFDWQRLGEGLVDKTEGTGLTLPKAQPLVAKCSPRPIMANLLSQI

SEQ ID NO: 13 - DNA, 183 bp, Nicotiana tabacum
ataggttttgcgactttagtgacacatctgacttttggtcgcttgcttcaaggttttgattttagtaagccatcaaacacgccaattgacatgacagaaggcgtaggcgttactttgcctaaggttaatcaagttgaagttctaattacccctcgtttaccttctaagctttatttattttga

SEQ ID NO: 14 - protein, 60 aa, Nicotiana tabacum
IGFATLVTHLTFGRLLQGFDFSKPSNTPIDMTEGVGVTLPKVNQVEVLITPRLPSKLYLF

SEQ ID NO: 15 - DNA, 178 bp, Nicotiana tabacum
ataggctttgcgactttagtgacacatctgacttttggtcgcttgcttcaaggttttgattttagtaagccatcaaacacgccaattgacatgacagaaggcgtaggcgttactttgcctaaggttaatcaagttgaagttctaattacccctcgtttaccttctaagctttatttat

SEQ ID NO: 16 - protein, 59 aa, Nicotiana tabacum
IGFATLVTHLTFGRLLQGFDFSKPSNTPIDMTEGVGVTLPKVNQVEVLITPRLPSKLYL

SEQ ID NO: 17 - DNA, 183 bp, Nicotiana tabacum
ataaattttgcgactttagtgacacatctgacttttggtcgcttgcttcaaggttttgattttagtacgccatcaaacacgccaatagacatgacagaaggcgtaggcgttactttgcctaaggtaaatcaagtggaagttctaattagccctcgtttaccttctaagctttatgtattctga

SEQ ID NO: 18 - protein, 60 aa, Nicotiana tabacum
INFATLVTHLTFGRLLQGFDFSTPSNTPIDMTEGVGVTLPKVNQVEVLISPRLPSKLYVF

SEQ ID NO: 19 - DNA, 171 bp, Nicotiana tabacum
attatacttgcattgccaattcttggcatcactttgggacgtttggttcagaactttgagctgttgcctcctccaggccagtcgaagctcgacaccacagagaaaggtggacagttcagtctccacattttgaagcattccaccattgtgttgaaaccaaggtctttctga

SEQ ID NO: 20 - protein, 56 aa, Nicotiana tabacum
IILALPILGITLGRLVQNFELLPPPGQSKLDTTEKGGQFSLHILKHSTIVLKPRSF

SEQ ID NO: 21 - DNA, 171 bp, Nicotiana tabacum
attatacttgcattgccaattcttggcattactttgggacgtttggttcagaactttgagctgttgcctcctccaggccagtcgaagctcgacaccacagagaaaggtggacagttcagtctccatattttgaagcattccaccattgtgttgaaaccaaggtcttgctga

SEQ ID NO: 22 - protein, 56 aa, Nicotiana tabacum
IILALPILGITLGRLVQNFELLPPPGQSKLDTTEKGGQFSLHILKHSTIVLKPRSC

SEQ ID NO: 23 - DNA, 172 bp, Nicotiana tabacum
tattgcacttggggttgcatcaatggaacttgcattgtcaaatcttctttatgcatttgattgggagttaccttttggaatgaaaaaagaagacattgacacaaacgccaggcctggaattaccatgcataagaaaaacgaactttatcttatccctaaaaattatctatag

SEQ ID NO: 24 - protein, 63 aa, Nicotiana tabacum
IALGVASMELALSNLLYAFDWELPFGMKKEDIDTNARPGITMHKKNELYLIPKNYLPSKLYLF

SEQ ID NO: 25 - DNA, 171 bp, Nicotiana tabacum
attgcacttggggttgcatccatggaacttgctttgtcaaatcttctttatgcatttgattgggagttaccttacggagtgaaaaaagaaaacattgacacaaatgtcaggcctggaattaccatgcataagaaaaacgaactttgccttatccctagaaattatctatag

SEQ ID NO: 26 - protein, 56 aa, Nicotiana tabacum
IALGVASMELALSNLLYAFDWELPYGVKKENIDTNVRPGITMHKKNELCLIPRNYL

SEQ ID NO: 27 - DNA, 174 bp, Nicotiana tabacum
ggtattgcacttggggttgcatccatggaacttgctttgtcaaatcttctttatgcatttgattgggagttgccttatggagtgaaaaaagaagacatcgacacaaacgttaggcctggaattgccatgcacaagaaaaacgaactttgccttgtcccaaaaaattatttataa

SEQ ID NO: 28 - protein, 56 aa, Nicotiana tabacum
IALGVASMELALSNLLYAFDWELPYGVKKEDIDTNVRPGIAMHKKNELCLVPKNYL

SEQ ID NO: 29 - DNA, 201 bp, Nicotiana tabacum
attgcacttggggttgcatccatggaacttgctttgtcaaatcttctttatgcatttgattgggagttgccttatggagtgaaaaaagaagacatcgacacaaacgttaggcctggaattgccatgcacaagaaaaacgaactttgccttgtcccaaaaaaattatttataaattatattgggacgtggatctcatgctag

SEQ ID NO: 30 - protein, 66 aa, Nicotiana tabacum
IALGVASMELALSNLLYAFDWELPYGVKKEDIDTNVRPGIAMHKKNELCLVPKKLFINYIGTWISC

SEQ ID NO: 31 - DNA, 183 bp, Nicotiana tabacum
atttcgtttggtttagctaatgcttatttgccattggctcaattactttatcactttgattgggaactccccactggaatcaaaccaagcgacttggacttgactgagttggttggagtaactgccgctagaaaaagtgacctttacttggttgcgactccttatcaacctcctcaaaactga

SEQ ID NO: 32 - protein, 60 aa, Nicotiana tabacum
ISFGLANAYLPLAQLLYHFDWELPTGIKPSDLDLTELVGVTAARKSDLYLVATPYQPPQN

SEQ ID NO: 33 - DNA, 183 bp, Nicotiana tabacum
atttcgtttggcttagctaatgcttatttgccattggctcaattactatatcacttcgattggaaactccctgctggaatcgaaccaagcgacttggacttgactgagttggttggagtaactgccgctagaaaaagtgacctttacttggttgcgactccttatcaacctcctcaaaagtga

SEQ ID NO: 34 - protein, 60 aa, Nicotiana tabacum
ISFGLANAYLPLAQLLYHFDWKLPAGIEPSDLDLTELVGVTAARKSDLYLVATPYQPPQK

SEQ ID NO: 35 - DNA, 220 bp, Nicotiana tabacum
atgctatttggtttagctaatgttggacaacctttagctcagttactttatcacttcgattggaaactccctaatggacaaagtcatgagaatttcgacatgactgagtcacctggaatttctgctacaagaaaggatgatcttgttttgattgccactccttatgattcttattaattccagtctatatcatctatatgtactcaataattgtatggga

SEQ ID NO: 36 - protein, 58 aa, Nicotiana tabacum
MLFGLANVGQPLAQLLYHFDWKLPNGQSHENFDMTESPGISATRKDDLVLIATPYDSY

SEQ ID NO: 37 - DNA, 174 bp, Nicotiana tabacum
atgctatttggtttagctaatgttggacaacctttagctcagttactttatcacttcgattggaaactccctaatggacaaactcaccaaaatttcgacatgactgagtcacctggaatttctgctacaagaaaggatgatcttattttgattgccactcctgctcattcttga

SEQ ID NO: 38 - protein, 57 aa, Nicotiana tabacum
MLFGLANVGQPLAQLLYHFDWKLPNGQTHQNFDMTESPGISATRKDDLILIATPAHS

SEQ ID NO: 39 - DNA, 177 bp, Nicotiana tabacum
ttattattcggtttagttaatgtaggacatcctttagctcaattgctttatcacttcgattggaagactcttcctgggataagttcagatagtttcgacatgactgaaacagatggagtaactgccggaagaaaggatgatctttgtttaattgctactccttttggtctcaattaa

SEQ ID NO: 40 - protein, 58 aa, Nicotiana tabacum
LLFGLVNVGHPLAQLLYHFDWKTLPGISSDSFDMTETDGVTAGRKDDLCLIATPFGLN

SEQ ID NO: 41 - DNA, 180 bp, Nicotiana tabacum
atgtcgtttggtttagttaacactgggcatcctttagctcagttgctctatttctttgactggaaattccctcataaggttaatgcagctgattttcacactactgaaacaagtagagtttttgcagcaagcaaagatgacctctacttgattccaacaaatcacatggagcaagagtag

SEQ ID NO: 42 - protein, 59 aa, Nicotiana tabacum
MSFGLVNTGHPLAQLLYFFDWKFPHKVNAADFHTTETSRVFAASKDDLYLIPTNHMEQE

SEQ ID NO: 43 - DNA, 180 bp, Nicotiana tabacum
atgtcgtttggtttagttaacacagggcatcctttagcccagttgctctattgctttgactggaaactccctgacaaggttaatgcaaatgattttcgcactactgaaacaagtagagtttttgcagcaagcaaagatgacctctacttgattcccacaaatcacagggagcaagaatag

SEQ ID NO: 44 - protein, 59 aa, Nicotiana tabacum
MSFGLVNTGHPLAQLLYCFDWKLPDKVNANDFRTTETSRVFAASKDDLYLIPTNHREQE

SEQ ID NO: 45 - DNA, 183 bp, Nicotiana tabacum
atgcaatttggtttggctcttgttactctgccattggctcatttgcttcacaattttgattggaaacttcccgaaggaattaatgcaagggatttggacatgacagaggcaaatgggatatctgctagaagagaaaaagatctttacttgattgctactccttatgtatcacctcttgattaa

SEQ ID NO: 46 - protein, 60 aa, Nicotiana tabacum
MQFGLALVTLPLAHLLHNFDWKLPEGINARDLDMTEANGISARREKDLYLIATPYVSPLD

SEQ ID NO: 47 - DNA, 177 bp, Nicotiana tabacum
atgacttatgcattgcaagtggaacacctaacaatggcacatttgatccagggtttcaattacagaactccaactgatgagcccttggatatgaaagaaggtgcaggcataactatacgtaaggtaaatcctgtgaaagtgataattacgcctcgcttggcacctgagctttattaa

SEQ ID NO: 48 - protein, 58 aa, Nicotiana tabacum
MTYALQVEHLTMAHLIQGFNYRTPTDEPLDMKEGAGITIRKVNPVKVIITPRLAPELY

SEQ ID NO: 49 - DNA, 177 bp, Nicotiana tabacum
atgacttatgcattgcaagtggaacacctaacaatggcacatttaatccagggtttcaattacaaaactccaaatgacgaggccttggatatgaaggaaggtgcaggcataactatacgtaaggtaaatcctgtggaactgataatagcgcctcgcctggcacctgagctttattaa

SEQ ID NO: 50 - protein, 58 aa, Nicotiana tabacum
MTYALQVEHLTMAHLIQGFNYKTPNDEALDMKEGAGITIRKVNPVELIIAPRLAPELY

SEQ ID NO: 51 - DNA, 177 bp, Nicotiana tabacum
atgacttatgcattgcaagtggaacacctaacaatggcacatttaatccagggtttcaattacaaaactccaaatgacgaggccttggatatgaaggaaggtgcaggcataacaatacgtaaggtaaatccagtggaattgataataacgcctcgcttggcacctgagctttactaa

SEQ ID NO: 52 - protein, 58 aa, Nicotiana tabacum
MTYALQVEHLTMAHLIQGFNYKTPNDEALDMKEGAGITIRKVNPVELIITPRLAPELY

SEQ ID NO: 53 - DNA, 177 bp, Nicotiana tabacum
atgacttatgcattgcaagtggaacacttaacaatggcacatttgatccaaggtttcaattacagaactccaaatgacgagcccttggatatgaaggaaggtgcaggcataactatacgtaaggtaaatcctgtggaactgataatagcgcctcgcctggcacctgagctttattaa

SEQ ID NO: 54 - protein, 58 aa, Nicotiana tabacum
MTYALQVEHLTMAHLIQGFNYRTPNDEPLDMKEGAGITIRKVNPVELIIAPRLAPELY

SEQ ID NO: 55 - DNA, 174 bp, Nicotiana tabacum
atgacttatgcattgcaagtggaacacttaacaatggcacatttgatccaaggtttcaattacagaactccaaatgacgagcccttggatatgaaggaaggtgcaggcataactatacgtaaggtaaatcctgtggaactgataatagcgcccctggcacctgagctttattaa

SEQ ID NO: 56 - protein, 57 aa, Nicotiana tabacum
MTYALQVEHLTMAHLIQGFNYRTPNDEPLDMKEGAGITIRKVNPVELIIAPLAPELY

SEQ ID NO: 57 - DNA, 177 bp, Nicotiana tabacum
atgacttatgcattgcaagtggaacacttaacaatggcacatttgatccaaggtttcaattacagaactccaaatgacgagcccttggatatgaaggaaggtgcaggcataactatacgtaaggtaaatcctgcggaactgataatagcgcctcgcctggcacctgagctttattaa

SEQ ID NO: 58 - protein, 58 aa, Nicotiana tabacum
MTYALQVEHLTMAHLIQGFNYRTPNDEPLDMKEGAGITIRKVNPAELIIAPRLAPELY

SEQ ID NO: 59 - DNA, 177 bp, Nicotiana tabacum
atgacttatgcattacaagtggaacacctaacaatagcacatttgatccagggtttcaattacaaaactccaaatgacgagcccttggatatgaaggaaggtgcaggattaaccatacgtaaagtaaatcctgtagaagtgacaactacggctcgcctggcacctgagctttattaa

SEQ ID NO: 60 - protein, 58 aa, Nicotiana tabacum
MTYALQVEHLTIAHLIQGFNYKTPNDEPLDMKEGAGLTIRKVNPVEVTTTARLAPELY

SEQ ID NO: 61 - DNA, 177 bp, Nicotiana tabacum
atgacttatgcattacaagtggaacacctaacaatagcacatttgatccagggtttcaattacaaaactccaaatgacgagcccttggatatgaaggaaggtgcaggattaactatacgtaaagtaaatcctgtagaagtgacaattacggctcgcctggcacctgagctttattaa

SEQ ID NO: 62 - protein, 58 aa, Nicotiana tabacum
MTYALQVEHLTIAHLIQGFNYKTPNDEPLDMKEGAGLTIRKVNPVEVTITARLAPELY

SEQ ID NO: 63 - DNA, 177 bp, Nicotiana tabacum
atgacttatgcattacaagtggaacacctaacaatagcacatttgatccagggtttcaattacaaaactccaaatgacgagcccctggatatgaaggaaggtgcaggattaactatacgtaaagtaaatcctgtagaagtgacaattacggctcgcctggcacctgagctttattaa

SEQ ID NO: 64 - protein, 58 aa, Nicotiana tabacum; identical to SEQ ID NO: 62

SEQ ID NO: 65 - DNA, 198 bp, Nicotiana tabacum
tatagccttggacttaaggttatccgagtaacattagccaacatgttgcatggattcaactggaaattacctgaaggtatgaagccagaagatataagtgtggaagaacattatgggctcactacacatcctaagtttcctgttcctgtgatcttggaatctagactttcttcagatctctattcccccatcacttaa

SEQ ID NO: 66 - protein, 65 aa, Nicotiana tabacum
YSLGLKVIRVTLANMLHGFNWKLPEGMKPEDISVEEHYGLTTHPKFPVPVILESRLSSDLYSPIT

SEQ ID NO: 67 - DNA, 190 bp, Nicotiana tabacum
atacagtcttgggattcgtataattagggcaactttagctaacttgttgcatggattcaactggagattgcctaatggtatgagtccagaagacattagcatggaagagatttatgggctaattacacaccccaaagtcgcacttgacgtgatgatggagcctcgacttcccaaccatctttacaaatag

SEQ ID NO: 68 - protein, 62 aa, Nicotiana tabacum
YSLGIRIIRATLANLLHGFNWRLPNGMSPEDISMEEIYGLITHPKVALDVMMEPRLPNHLYK

SEQ ID NO: 69 - DNA, 174 bp, Nicotiana tabacum
attaatttttcaataccacttgttgagcttgcacttgctaatctattgtttcattataattggtcacttcctgaagggatgctagctaaggatgttgatatggaagaagctttggggattaccatgcacaagaaatctcccctttgcttagtagcttctcattatacttgttga

SEQ ID NO: 70 - protein, 57 aa, Nicotiana tabacum
INFSIPLVELALANLLFHYNWSLPEGMLAKDVDMEEALGITMHKKSPLCLVASHYTC

SEQ ID NO: 71 - DNA, 190 bp, Nicotiana tabacum
atgcaacttgggctttatgcattggaaatggctgtggcccatcttcttcattgttttacttgggaattgccagatggtatgaaaccaagtgagcttaaaatggatgatatttttggactcactgctccaaaagctaatcgactcgtggctgtgcctactccacgtttgttgtgtcccctttattaattga

SEQ ID NO: 72 - protein, 61 aa, Nicotiana tabacum
MQLGLYALEMAVAHLLHCFTWELPDGMKPSELKMDDIFGLTAPKANRLVAVPTPRLLCPLY

SEQ ID NO: 73 - DNA, 186 bp, Nicotiana tabacum
atgcaacttgggctttatgcattagaaatggcagtggcccatcttcttctttgctttacttgggaattgccagatggtatgaaaccaagtgagcttaaaatggatgatatttttggactcactgctccaagagctaatcgactcgtggctgtgcctagtccacgtttgttgtgcccactttattaa

SEQ ID NO: 74 - protein, 61 aa, Nicotiana tabacum
MQLGLYALEMAVAHLLLCFTWELPDGMKPSELKMDDIFGLTAPRANRLVAVPSPRLLCPLY

SEQ ID NO: 75 - DNA, 186 bp, Nicotiana tabacum
atgcaacttgggctttatgcattggaaatggctgtggcccatcttcttcattgttttacttgggaattgccagatggtatgaaaccaagtgagcttaaaatggatgatatttttggactcactgctccaagagctaatcgactcgtggctgtgcctactccacgtttgttgtgtcccctttattaa

SEQ ID NO: 76 - protein, 61 aa, Nicotiana tabacum
MQLGLYALEMAVAHLLHCFTWELPDGMKPSELKMDDIFGLTAPRANRLVAVPTPRLLCPLY

SEQ ID NO: 77 - DNA, 93 bp, Nicotiana tabacum
atgctttggagtgcgagtatagtgcgcgtcagctacctaacttgtatttatagattccaagtatatgctgggtctgtgttcagagtagcatga

SEQ ID NO: 78 - protein, 30 aa, Nicotiana tabacum
MLWSASIVRVSYLTCIYRFQVYAGSVFRVA

SEQ ID NO: 79 - DNA, 93 bp, Nicotiana tabacum; identical to SEQ ID NO: 77

SEQ ID NO: 80 - protein, 30 aa, Nicotiana tabacum; identical to SEQ ID NO: 78

SEQ ID NO: 81 - DNA, 93 bp, Nicotiana tabacum
atgctttggagtgcgagtatagtgcgcgtcagctacctaacctgtatttatagattccaagtatatgctgggtctgtgttcagagtagcatga

SEQ ID NO: 82 - protein, 30 aa, Nicotiana tabacum; identical to SEQ ID NO: 78

SEQ ID NO: 83 - DNA, 177 bp, Nicotiana tabacum
attaatttttcaataccacttgttgagcttgcacttgctaatctattgtttcattataattggtcacttcctgaggggatgctacctaaggatgttgatatggaagaagctttggggattaccatgcacaagaaatctcccctttgcttagtagcttctcattataacttgttgtga

SEQ ID NO: 84 - protein, 58 aa, Nicotiana tabacum
INFSIPLVELALANLLFHYNWSLPEGMLPKDVDMEEALGITMHKKSPLCLVASHYNLL

SEQ ID NO: 85 - DNA, 183 bp, Nicotiana tabacum
atatcatttggtttggctaatgtttatttgccactagctcaattgttatatcattttgattggaaactccctactggaatcaattcaagtgacttggacatgactgagtcgtcaggagtaacttgtgctagaaagagtgatttatacttgactgctactccatatcaactttctcaagagtga

SEQ ID NO: 86 - protein, 61 aa, Nicotiana tabacum
GISFGLANVYLPLAQLLYHFDWKLPTGINSSDLDMTESSGVTCARKSDLYLTATPYQLSQE

SEQ ID NO: 87 - DNA, 93 bp, Nicotiana tabacum
atgctttggagtgcgagtatagtgcgcgtcagctacctaacttgtatttatagattccaagtatatgctgggtctgtgtccagagtagcatga

SEQ ID NO: 88 - protein, 30 aa, Nicotiana tabacum
MLWSASIVRVSYLTCIYRFQVYAGSVSRVA

SEQ ID NO: 89 - DNA, 153 bp, Nicotiana tabacum
ctgaattttgcaatgttagaggcaaaaatggcacttgcattgattctacaacactatgcttttgagctctctccatcttatgcacatgctcctcatacaattatcactctgcaacctcaacatggtgctcctttgattttgcgcaagctgtag

SEQ ID NO: 90 - protein, 50 aa, Nicotiana tabacum
LNFAMLEAKMALALILQHYAFELSPSYAHAPHTIITLQPQHGAPLILRKL

SEQ ID NO: 91 - DNA, 153 bp, Nicotiana tabacum
ctgaattttgcaatgttagaggcaaaaatggcacttgcattgattctacaacactatgcttttgagctctctccatcttatgcacacgctcctcatacaattatcactctgcaacctcaacatggtgctcctttgattttgcgcaagctgtag

SEQ ID NO: 92 - protein, 50 aa, Nicotiana tabacum; identical to SEQ ID NO: 90

SEQ ID NO: 93 - DNA, 226 bp, Nicotiana tabacum
aataattttgcaatgttggaaactaagattgccttagcaatgatcctacagcgttttgctttcgagctttctccatcttacgctcatgcacctacttatgtcgtcactcttcgacctcagtgtggtgctcacttaatcttgcaaaaattataggtccttaatctggatttcccattattgagtagtgcctaataaatcttctctatcactatttttccatctttca

SEQ ID NO: 94 - protein, 50 aa, Nicotiana tabacum
NNFAMLETKIALAMILQRFAFELSPSYAHAPTYVVTLRPQCGAHLILQKL

SEQ ID NO: 95 - DNA, 268 bp, Nicotiana tabacum
agcgaaggggtggcaaaggcaacaaaggggaaaatgacatattttccatttggtgcaggaccgcgaaaatgcattgggcaaaacttcgcgattttggaagcaaaaatggctatagctatgattctacaacgcttctccttcgagctctccccatcttatacacactctccatacactgtggtcactttgaaacccaaatatggtgctcccctaataatgcacaggctgtagtcctgtgagaatatgctatccgaggaattcagttcct

SEQ ID NO: 96 - protein, 50 aa, Nicotiana tabacum
QNFAILEAKMAIAMILQRFSFELSPSYTHSPYTVVTLKPKYGAPLIMHRL

SEQ ID NO: 97 - DNA, 237 bp, Nicotiana tabacum
agcgaaggggtggcaaaggcaacaaaggggaaaatgacatattttccatttggtgcaggaccgcgaaaatgcattgggcaaaacttcgcgattttggaagcaaaaatggctatagctatgattctacaacgcttctccttcgagctctctccatcttatacacactctccatacactgtggtcactttgaaacccaaatatggtgctcccctaataatgcacaggctgtagtcctgt

SEQ ID NO: 98 - protein, 50 aa, Nicotiana tabacum; identical to SEQ ID NO: 96

SEQ ID NO: 99 - DNA, 152 bp, Nicotiana tabacum
caaaattttgccatgttagaagcaaagatggctctgtctatgatcctgcaacgcttctcttttgaactgtctccgtcttatgcacatgcccctcagtccatattaaccgtcagccacaatatggtgctccacttattttccacaagctataa

SEQ ID NO: 100 - protein, 50 aa, Nicotiana tabacum
QNFAMLEAKMALSMILQRFSFELSPSYAHAPQSILTVQPQYGAPLIFHKL

SEQ ID NO: 101 - DNA, 153 bp, Nicotiana tabacum
ataaactttgcaatgacagaagcgaagatggctatggctatgattctgcaacgcttctcctttgagctatctccatcttacacacatgctccacagtctgtaataactatgcaaccccaatatggtgctcctcttatattgcacaaattgtaa

SEQ ID NO: 102 - protein, 50 aa, Nicotiana tabacum
INFAMTEAKMAMAMILQRFSFELSPSYTHAPQSVITMQPQYGAPLILHKL

SEQ ID NO: 103 - DNA, 153 bp, Nicotiana tabacum
ataaactttgcaatggcagaagcgaagatggctatggctatgattctgcaacgcttctcctttgagctatctccatcttacacacatgctccacagtctgtaataactatgcaaccccaatatggtgctcctcttatattgcacaaattgtaa

SEQ ID NO: 104 - protein, 50 aa, Nicotiana tabacum
INFAMAEAKMAMAMILQRFSFELSPSYTHAPQSVITMQPQYGAPLILHKL

SEQ ID NO: 105 - DNA, 153 bp, Nicotiana tabacum
caaaactttgcaatgatggaagcaaaaatggcagtagctatgatactacaaaaattttcctttgaactatccccttcttatacacatgctccatttgcaattgtgactattcatcctcagtatggtgctcctctgcttatgcgcagactttaa

SEQ ID NO: 106 - protein, 50 aa, Nicotiana tabacum
QNFAMMEAKMAVAMILQKFSFELSPSYTHAPFAIVTIHPQYGAPLLMRRL

SEQ ID NO: 107 - DNA, 153 bp, Nicotiana tabacum
caaaactttgcaatgatggaagcaaaaatggcagtagctatgatactacataaattttcctttgaactatccccttcttatacacatgctccatttgcaattgtgactattcatcctcagtatggtgctcctctgcttatgcgcagactttaa

SEQ ID NO: 108 - protein, 49 aa, Nicotiana tabacum
QNFAMMEAKMAVAMILHKFSFELPSYTHAPFAIVTIHPQYGAPLLMRRL

SEQ ID NO: 109 - DNA, 150 bp, Nicotiana tabacum
caaaattttgctatgttagaggctaaaatggcaatggctatgattctgaaaacctatgcatttgaactctctccatcttatgctcatgctcctcatccactactacttcaacctcaatatggtgctcaattaattttgtacaagttgtag

SEQ ID NO: 110 - protein, 49 aa, Nicotiana tabacum
QNFAMLEAKMAMAMILKTYAFELSPSYAHAPHPLLLQPQYGAQLILYKL

SEQ ID NO: 111 - DNA, 192 bp, Nicotiana tabacum
tatagcatggggctcaaggcgattcaagctagcttagctaatcttctacatggatttaactggtcattgcctgataatatgactcctgaggacctcaacatggatgagatttttgggctctctacacctaaaaaatttccacttgctactgtgattgagccaagactttcaccaaaactttactctgtttga

SEQ ID NO: 112 - protein, 63 aa, Nicotiana tabacum
YSMGLKAIQASLANLLHGFNWSLPDNMTPEDLNMDEIFGLSTPKKFPLATVIEPRLSPKLYSV

SEQ ID NO: 113 - DNA, 192 bp, Nicotiana tabacum
tatagcttggggctcaaggagattcaagctagcttagctaatcttctacatggatttaactggtcattgcctgataatatgactcctgaggacctcaacatggatgagatttttgggctctctacacctaaaaaatttccacttgctactgtgattgagccaagactttcaccaaaactttactctgtttga

SEQ ID NO: 114 - protein, 63 aa, Nicotiana tabacum
YSLGLKEIQASLANLLHGFNWSLPDNMTPEDLNMDEIFGLSTPKKFPLATVIEPRLSPKLYSV

SEQ ID NO: 115 - DNA, 192 bp, Nicotiana tabacum
catagcttggggctcaaggtgattcaagctagcttagctaatcttctacatggatttaactggtcattgcctgataatatgactcctgaggacctcaacatggatgagatttttgggctctctacacctaaaaaatttccacttgctactgtgattgagccaagactttcaccaaaactttactctgtttga

SEQ ID NO: 116 - protein, 63 aa, Nicotiana tabacum
HSLGLKVIQASLANLLHGFNWSLPDNMTPEDLNMDEIFGLSTPKKFPLATVIEPRLSPKLYSV

SEQ ID NO: 117 - DNA, 96 bp, Nicotiana tabacum
ctgtgctttccatgtttaatctctagttatatactggctttgaatgtgaatctgtatcataatttcttgcaaatttctccttccatttcttattaa

SEQ ID NO: 118 - protein, 31 aa, Nicotiana tabacum
LCFPCLISSYILALNVNLYHNFLQISPSISY

SEQ ID NO: 119 - DNA, 192 bp, Nicotiana tabacum
tctggacttgctcaatgtgtggttggtttagctttagcaactctagtgcagtgttttgagtggaaaagggtaagcgaagaggtggttgatttgacggaaggaaaaggtctcactatgccaaaacccgagccactcatggctaggtgcgaagctcgtgacatttttcacaaagttctttcagaaatatcttaa

SEQ ID NO: 120 - protein, 63 aa, Nicotiana tabacum
SGLAQCVVGLALATLVQCFEWKRVSEEVVDLTEGKGLTMPKPEPLMARCEARDIFHKVLSEIS

SEQ ID NO: 121 - DNA, 174 bp, Nicotiana tabacum
ttgggcttggcaacggtgcatgtgaatttgatgttggcccgaatgattcaagaatttgaatggtccgcttacccggaaaataggaaagtggattttactgagaaattggaatttactgtggtgatgaaaaatcctttaagagctaaggtcaagccaagaatgcaagtggtgtaa

SEQ ID NO: 122 - protein, 57 aa, Nicotiana tabacum
LGLATVHVNLMLARMIQEFEWSAYPENRKVDFTEKLEFTVVMKNPLRAKVKPRMQVV

SEQ ID NO: 123 - DNA, 171 bp, Nicotiana tabacum
tatgctttggctatgcttcatttagagtactttgtggctaatttggtttggcattttcgatgggaggctgtggagggagatgatgttgatctttcagaaaagctagaattcaccgttgtgatgaagaatccacttcgagctcgtatctgccccagagttaactctatttga

SEQ ID NO: 124 - protein, 56 aa, Nicotiana tabacum
YALAMLHLEYFVANLVWHFRWEAVEGDDVDLSEKLEFTVVMKNPLRARICPRVNSI

SEQ ID NO: 125 - DNA, 186 bp, Nicotiana tabacum
ggtcagcaagttggacttcttagaacaaccattttcatcgcctcattactgtctgaatataagctgaaacctcgctcacaccagaaacaagttgaactcaccgatttaaatccagcaagttggcttcattcgataaaaggcgaactgttagtcgatgcgattcctcgaaagaaggcggcattttaa

SEQ ID NO: 126 - protein, 61 aa, Nicotiana tabacum
GQQVGLLRTTIFIASLLSEYKLKPRSHQKQVELTDLNPASWLHSIKGELLVDAIPRKKAAF

SEQ ID NO: 127 - DNA, 171 bp, Nicotiana tabacum
atcacatttgctaagtttgtgaatgagctagcattggcaagattaatgttccattttgatttctcgctaccaaaaggagttaagcatgaggatttggacgtggaggaagctgctggaattactgttagaaggaagttcccccttttagccgtcgccactccatgctcgtga

SEQ ID NO: 128 - protein, 56 aa, Nicotiana tabacum
ITFAKFVNELALARLMFHFDFSLPKGVKHEDLDVEEAAGITVRRKFPLLAVATPCS

SEQ ID NO: 129 - DNA, 180 bp, Nicotiana tabacum
cagaggtatgctataaaccatttgatgctctttattgcgttgttcacggctctgattgatttcaagaggcacaaaacggacggctgtgatgatatcgcgtatattccaaccattgctccaaaggatgattgtaaagtgttcctttcacagaggtgcactcgattcccatctttttcatga

SEQ ID NO: 130 - protein, 59 aa, Nicotiana tabacum
QRYAINHLMLFIALFTALIDFKRHKTDGCDDIAYIPTIAPKDDCKVFLSQRCTRFPSFS

SEQ ID NO: 131 - DNA, 183 bp, Nicotiana tabacum
atgtcatttggtttagctaatctttacttaccattggctcaattactctatcactttgactggaaactcccaaccggaatcaagccaagagacttggacttgaccgaattatcgggaataactattgctagaaagggtgacctttacttaaatgctactccttatcaaccttctcgagagtaa

SEQ ID NO: 132 - protein, 60 aa, Nicotiana tabacum
MSFGLANLYLPLAQLLYHFDWKLPTGIKPRDLDLTELSGITIARKGDLYLNATPYQPSRE

SEQ ID NO: 133 - DNA, 174 bp, Nicotiana tabacum
ttgggcttggcaacggtgcatgtgaatttgatgttggcccgaacgattcaagaatttgaatggtccgcttacccggaaaataggaaagtggattttactgagaaattggaatttactgtggtgatgaaaaaccctttaagagctaaggtcaagccaagaatgcaagtggtgtaa

SEQ ID NO: 134 - protein, 57 aa, Nicotiana tabacum
LGLATVHVNLMLARTIQEFEWSAYPENRKVDFTEKLEFTVVMKNPLRAKVKPRMQVV

SEQ ID NO: 135 - DNA, 123 bp, Nicotiana tabacum
ttgggcttggcaacggtgcatgtgaatttgatgttggcccgaatgattcaagaatttgaatggtccgcttacccggaaaataggaaagtggatttactgagaaattggaatttactgtggtga

SEQ ID NO: 136 - protein, 40 aa, Nicotiana tabacum
LGLATVHVNLMLARMIQEFEWSAYPENRKVDLLRNWNLLW

SEQ ID NO: 137 - DNA, 171 bp, Nicotiana tabacum
atcacatttgctaagtttgtgaatgagctagcattggcaagattaatgttccattttgatttctcgctaccaaaaggagttaagcatgaggatttggacgtggaggaagctgctggaattactgttaggaggaagttcccccttttagccgtcgccactccatgctcgtga

SEQ ID NO: 138 - protein, 56 aa, Nicotiana tabacum; identical to SEQ ID NO: 128

SEQ ID NO: 139 - DNA, 171 bp, Nicotiana tabacum
atcacatttgctaagtttgtgaatgagctagcattggcaagattaatgttccattttgatttctcgctaccaaaaggagttaagcatgcggatttggacgtggaggaagctgctggaattactgttagaaggaagttcccccttttagccgtcgccactccatgctcgtga

SEQ ID NO: 140 - protein, 56 aa, Nicotiana tabacum
ITFAKFVNELALARLMFHFDFSLPKGVKHADLDVEEAAGITVRRKFPLLAVATPCS

SEQ ID NO: 141 - DNA, 153 bp, Nicotiana tabacum
caaaattttgccatgttagaagcaaagactactttggctatgatcctacaacgcttctcctttgaactgtctccatcttatgcacatgctcctcagtccataataactttgcaaccccagtatggtgctccacttattttgcataaaatatag

SEQ ID NO: 142 - protein, 50 aa, Nicotiana tabacum
QNFAMLEAKTTLAMILQRFSFELSPSYAHAPQSIITLQPQYGAPLILHKI

SEQ ID NO: 143 - DNA, 171 bp, Nicotiana tabacum
attatccttgcactgccaattcttggcattaccttgggacgcttggtgcagaactttgagttgttgcctcctccaggacagtcaaagcttgacacaacagagaaaggcgggcaattcagtctgcacattttgaagcattccaccattgtgatgaaaccaagatctttttaa

SEQ ID NO: 144 - protein, 56 aa, Nicotiana tabacum
IILALPILGITLGRLVQNFELLPPPGQSKLDTTEKGGQFSLHILKHSTIVMKPRSF

SEQ ID NO: 145 - DNA, 267 bp, Nicotiana tabacum
caaaattttgccatgttagaagcaaagactactttggctatgatcctacaacgcttctcctttgaactgtctccatcttatgcacatgctcctcagtccataataacttgcaaccccagtatggtgctccacttattttgcataaaatatagtttattacttgtaagtagtgtctcgttttatgttaagcatgagtccaaaatgttaaggcttgtagaactgcaaaatgggaatgcatttgcactcgtgcactgtagattgttgtaa

SEQ ID NO: 146 - protein, 88 aa, Nicotiana tabacum
QNFAMLEAKTTLAMILQRFSFELSPSYAHAPQSIITCNPSMVLHLFCIKYSLLLVSSVSFYVKHESKMLRLVELQNGNAFALVHCRLL

SEQ ID NO: 147 - DNA, 186 bp, Nicotiana tabacum
gctgatatggggttgcgagcagtttctttggcattaggtgcacttattcaatgctttgactggcaaattgaggaagcggaaagcttggaggaaagctataattctagaatgactatgcagaacaagcctttgaaggttgtctgcactccacgcgaagatcttggccagcttctatcccaactctaa

SEQ ID NO: 148 - protein, 61 aa, Nicotiana tabacum
ADMGLRAVSLALGALIQCFDWQIEEAESLEESYNSRMTMQNKPLKVVCTPREDLGQLLSQL

SEQ ID NO: 149 - DNA, 1576 bp, Nicotiana tabacum
cttccttcctaagtcctaactaaaaatggagattcagttttctaacttagttgcattcttgctctttctctccagcatctttcttctattcaaaaaatggaaaaccagaaaactaaatttgcctcctggtccatggaaattaccttttattggaagtttacaccatttggctgtggcaggtccacttcctcaccatggcctaaaaaatttagccaaacgctatggtcctcttatgcatttacaacttggacaaattcctacactcatcatatcatcacctcaaatggcaaaagaagtactaaaaactcacgacctcgcttttgccactagaccaaagcttgtcgcggccgacatcattcactacgacagcacggacatagcattttctccgtacggtgaatactggagacaaattcgtaaaatttgcatattggaactcttgagtgccaagatggtcaaattttttagctcgattcgccaagatgagctctcgaagatgctctcatctatacgaacgacacccaatcttacagtcaatcttactgacaaaattttttggtttacgagttcggtaacttgtagatcagctttagggaagatatgtggtgaccaagacaaattgatcatttttatgagggaaataatatcattggcaggtggatttagtattgctgattttttccctacatggaaaatgattcatgatattgatggttcgaaatctaaactggtgaaagcacatcgtaagattgatgaaattttgggaaatgttgttgatgagcacaaaaagaacagagcagatggcaagaagggtaatggtgaatttggtggtgaagatttgattgatgtattgttaagagttagagaaagtggagaagttcaaattcctatcacaaatgacaatatcaaatcaatattaatcgacatgttctctgcaggatctgaaacatcatcgacgactataatttgggcattagctgaaatgatgaagaaaccaagtgttttagcaaaggcacaagctgaagtaaggcaagctttgaaggagaaaaaaggttttcaacagattgatcttgatgagctaaaatatctcaagttagtaatcaaagaaaccttaagaatgcaccctccaattcctctattagttcctagagaatgtatggaggatacaaagattgatggttacaatatacctttcaaaacaagagtcatagttaatgcatgggcaatcggacgagatccagaaagttgggatgaccccgaaagctttatgccagagagatttgagaatagttctattgactttcttggaaatcatcatcagtttataccatttggtgcaggaagaaggatttgtccgggaatgctatttggtttagctaatgttggacaacctttagctcagttactttatcacttcgattggaaactccctaatggacaaagtcatgagaatttcgacatgactgagtcacctggaatttctgctacaagaaaggatgatcttgttttgattgccactccttatgattcttattaagcagtagcagaaataaaaagccggggcaaacagaaaaaa

SEQ ID NO: 150 - protein, 503 aa, Nicotiana tabacum
MEIQFSNLVAFLLFLSSIFLLFKKWKTRKLNLPPGPWKLPFIGSLHHLAVAGPLPHHGLKNLAKRYGPLMHLQLGQIPTLIISSPQMAKEVLKTHDLAFATRPKLVAADIIHYDSTDIAFSPYGEYWRQIRKICILELLSAKMVKFFSSIRQDELSKMLSSIRTTPNLTVNLTDKIFWFTSSVTCRSALGKICGDQDKLIIFMREIISLAGGFSIADFFPTWKMIHDIDGSKSKLVKAHRKIDEILGNVVDEHKKNRADGKKGNGEFGGEDLIDVLLRVRESGEVQIPITNDNIKSILIDMFSAGSETSSTTIIWALAEMMKKPSVLAKAQAEVRQALKEKKGFQQIDLDELKYLKLVIKETLRMHPPIPLLVPRECMEDTKIDGYNIPFKTRVIVNAWAIGRDPESWDDPESFMPERFENSSIDFLGNHHQFIPFGAGRRICPGMLFGLANVGQPLAQLLYHFDWKLPNGQSHENFDMTESPGISATRKDDLVLIATPYDSY

SEQ ID NO: 151 - DNA, 1581 bp, Nicotiana tabacum
tccttcttccttcctaagtcctaactaaaaatggagattcagttttctaacttagttgcattcttgctctttctctccagcatctttcttctattcaaaaaatggaaaaccagaaaactaaatttgcctcctggtccatggaaattaccttttattggaagtttacaccatttggctgtggcaggtccacttcctcaccatggcctaaaaaatttagccaaacgctatggtcctcttatgcatttacaacttggacaaattcctacactcatcatatcatcacctcaaatggcaaaagaagtactaaaaactcacgacctcgcttttgccactagaccaaagcttgtcgtggccgacatcattcactacgacagcacggacatagcattttctccgtacggtgaatactggagacaaattcgtaaaatttgcatattggaactcttgagtgccaagatggtcaaattttttagctcgattcgccaagatgagctctcgaagatgctctcatctatacgaacgacacccaatcttacagtcaatcttactgacaaaattttttggtttacgagttcggtaacttgtagatcagctttagggaagatatgtggtgaccaagacaaattgatcatttttatgagggaaataatatcattggcaggtggatttagtattgctgattttttccctacatggaaaatgattcatgatattgatggttcgaaatctaaactggtgaaagcacatcgtaagattgatgaaattttgggaaatgttgttgatgagcacaaaaagaacagagcagatggcaagaagggtaatggtgaatttggtggtgaagatttgattgatgtattgttaagagttagagaaagtggagaagttcaaattcctatcacaaatgacaatatcaaatcaatattaatcgacatgttctctgcgggatctgaaacatcatcgacgactataatttgggcattagctgaaatgatgaagaaaccaagtgttttagcaaaggcacaagctgaagtaaggcaagctttgaaggagaaaaaaggttttcaacagattgatcttgatgagctaaaatatctcaagttagtaatcaaagaaaccttaagaatgcaccctccaattcctctattagttcctagagaatgtatggaggatacaaagattgatggttacaatatacctttcaaaacaagagtcatagttaatgcatgggcaatcggacgagatccagaaagttgggatgaccccgaaagctttatgccagagagatttgagaatagttctattgactttcttggaaatcatcatcagtttataccatttggtgcaggaagaaggatttgtccgggaatgctatttggtttagctaatgttggacaacctttagctcagttactttatcacttcgattggaaactccctaatggacaaagtcatgagaatttcgacatgactgagtcacctggaatttctgctacaagaaaggatgatcttgttttgattgccactccttatgattcttattaagcagtagcagaaataaaaagccggggcaaacagaaaaaa

SEQ ID NO: 152 - protein, 503 aa, Nicotiana tabacum
MEIQFSNLVAFLLFLSSIFLLFKKWKTRKLNLPPGPWKLPFIGSLHHLAVAGPLPHHGLKNLAKRYGPLMHLQLGQIPTLIISSPQMAKEVLKTHDLAFATRPKLVVADIIHYDSTDIAFSPYGEYWRQIRKICILELLSAKMVKFFSSIRQDELSKMLSSIRTTPNLTVNLTDKIFWFTSSVTCRSALGKICGDQDKLIIFMREIISLAGGFSIADFFPTWKMIHDIDGSKSKLVKAHRKIDEILGNVVDEHKKNRADGKKGNGEFGGEDLIDVLLRVRESGEVQIPITNDNIKSILIDMFSAGSETSSTTIIWALAEMMKKPSVLAKAQAEVRQALKEKKGFQQIDLDELKYLKLVIKETLRMHPPIPLLVPRECMEDTKIDGYNIPFKTRVIVNAWAIGRDPESWDDPESFMPERFENSSIDFLGNHHQFIPFGAGRRICPGMLFGLANVGQPLAQLLYHFDWKLPNGQSHENFDMTESPGISATRKDDLVLIATPYDSY

SEQ ID NO: 153 - DNA, 1538 bp, Nicotiana tabacum
caactgcagtttgaagataccaactaaccaaaatgcagttcttcagcttggtttccattttcctatttctatcttttctctttttgttaaggaaatggaagaactcgaatagccaaaggaaaaaattgccaccaggtccatggaaactaccaatactaggaagtatgcttcatatggttggtggactaccacaccatgtccttagagatttagccaaaaaatatggaccgcttatgcaccttcaattaggtgaagtttctgcagttgtggttacttctcctgatatggcaaaagaagtactaaaaactcatgacatcgctttcgcgtctaggcctagccttttggccccggagattgtctgttacaataggtctgatcttgcgttttgcccctatggcgattattggagacaaatgcgtaaaatatgtgtcttggaagtgctcagtgccaagaatgttcggacatatagctctattaggcgcgatgaagttcttcgtctccttaattttatccggtcatcttctggtgagcctgttaatattacggaaaggatctttttgttcacaagctccatgacatgtagatcagcgtttgggcaagtattcaaggagcaagacaaatttatacaactaattaaagaagttatactcttagcaggagggtttgatgtggctgacatattcccttcatacaagtctcttcatgtgctcagtggaatgaagggtaagattatgaatgcacaccataaggtagatgctattgttgagaatgtcatcaacgagcacaagaaaaatcttgcaattgggaaaactaatggagcgttaggaggtgaagatttaattgatgttcttctaaaacttatgaatgatggaggccttcaatttcctatcaccaacgacaacatcaaagctataatctttgacatgtttgctgctggaacagagacttcatcgtcaacaattgtgtgggctatggtggaaatggtgaaaaatccaactgtatttgcgaaagctcaagcagaagtaagagatgcatttagagaaaaagaaacttttgatgaaaatgatgtggaggagctaaactatctaaagttagtcattaaagaaactctaagacttcatccaccggttccacttttgctcccaagagaatgtagggaagagacaaatataaacggctacactattcctgtaaagaccaaagtcatggttaatgtttgggcattgggaagagatccaaaatattgggatgatgcagaaacttttaagccagagagatttgagcagtgctctaaggattttgttggtaataattttgaatatcttccatttggtggtggaaggaggatttgtccagggatttcgtttggtttagctaatgcttatttgccattggctcaattactttatcactttgattgggaactccccactggaatcaaaccaagcgacttggacttgactgagttggttggagtaactgccgctagaaaaagtgacctttacttggttgcgactccttatcaacctcctcaaaac

SEQ ID NO: 154 - protein, 502 aa, Nicotiana tabacam
MQFFSLVSIFLFLSFLFLLRKWKNSNSQRKKLPPGPWKLPILGSMLHMVGGLPHHVLRDLAKKYGPLMHLQLGEVSAVVVTSPDMAKEVLKTHDIAFASRPSLLAPEIVCYNRSDLAFCPYGDYWRQMRKICVLEVLSAKNVRTYSSIRRDEVLRLLNFIRSSSGEPVNITERIFLFTSSMTCRSAFGQVFKEQDKFIQLIKEVILLAGGFDVADIFPSYKSLHVLSGMKGKIMNAHHKVDAIVENVINEHKKNLAIGKTNGALGGEDLIDVLLKLMNDGGLQFPITNDNIKAIIFDMFAAGTETSSSTIVWAMVEMVKNPTVFAKAQAEVRDAFREKETFDENDVEELNYLKLVIKETLRLHPPVPLLLPRECREETNINGYTIPVKTKVMVNVWALGRDPKYWDDAETFKPERFEQCSKDFVGNNFEYLPFGGGRRICPGISFGLANAYLPLAQLLYHFDWELPTGIKPSDLDLTELVGVTAARKSDLYLVATPYQPPQN

SEQ ID NO: 155 - DNA, 1530 bp, Nicotiana tabacum
aaaagatgtcttcattttccacatcttctgccacttctaattccaaacttccagttcgagaaatcccaggagactatggtttccccttttttggagccataaaagatagatatgactacttctacaacctcggcacagacgaattctttcttaccaaaatgcaaaaatacaactctactgtctttagaaccaacatgccaccaggtccattcattgctaaaaatcccaaagtaattgttctcctcgatgccaaaacatttcccgttcttttcgacaactctaaagtcgaaaaaatgaacgttcttgatggcacgtacgtgccatctactgatttctatggcggatatcgcccgtgtgcttatcttgatccttctgagtcaactcatgccacacttaaagggttctttttatctttaatctcccagcttcataatcaatttattcctttatttagaacctcaatttctggtcttttcgcaaatcttgagaatgagatttcccaaaatggcaaagcgaacttcaacaatatcagcgacattatgtcattcgattttgtttttcgtttgttatgtgacaagaccagtccccatgacacaaatcttggctctaatggaccaaaactctttgatatatggctgttgcctcaacttgctccattgtttagtctaggtctaaaatttgtgccgaactttctggaagatttaatgttgcatacttttcccttgccattttttctagtgagatcgaattaccagaagctttatgatgcttttagcaagcatgccgaaagtacactgaatgaagcagagaagaatgggatcaaaagagacgaagcatgccacaacttagtttttcttgcaggtttcaatgcttatggtgggatgaaagttttattccctgcactgataaagtgggtcgccaatggaggaaagagtttacacactcggctggcaaatgaaatcaggacaattatcaaagaagaatgtgggaccataactctatcagcaatcaacaagatgagtttagtaaaatcagtagtgtatgaagtattaagaattgaacctccagttccattccaatatggtaaagccaaagaagatatcataatccaaagccatgattcaactttcttagtcaagaaaggtgaaatgatctttggatatcagccttttgctacaaaagatccaaagatttttgacaaaccagaggagtttattccggagaggttcatggccgaaggggaaaaattattaaagtatgtgtattggtcaaatgcaagagagacagatgatccaacggtggacaacaaacaatgcccagcgaaaaatcttgtcgtgcttttgtgcaggttgatgttggtggaggttttcatgcgttacgacacattcacagtggagtcaacaaagctctttcttgggtcatcagtaacgttcacgactctggaaaaagcgacatgagtttcagatatcttaattgtaggctgcaaataataatgtggtcattctgcaaattattgtacttgtgctgatg

SEQ ID NO: 156 - protein, 483 aa, Nicotiana tabacum
MSSFSTSSATSNSKLPVREIPGDYGFPFFGAIKDRYDYFYNLGTDEFFLTKMQKYNSTVFRTNMPPGPFIAKNPKVIVLLDAKTFPVLFDNSKVEKMNVLDGTYVPSTDFYGGYRPCAYLDPSESTHATLKGFFLSLISQLHNQFIPLFRTSISGLFANLENEISQNGKANFNNISDIMSFDFVFRLLCDKTSPHDTNLGSNGPKLFDIWLLPQLAPLFSLGLKFVPNFLEDLMLHTFPLPFFLVRSNYQKLYDAFSKHAESTLNEAEKNGIKRDEACHNLVFLAGFNAYGGMKVLFPALIKWVANGGKSLHTRLANEIRTIIKEECGTITLSAINKMSLVKSVVYEVLRIEPPVPFQYGKAKEDIIIQSHDSTFLVKKGEMIFGYQPFATKDPKIFDKPEEFIPERFMAEGEKLLKYVYWSNARETDDPTVDNKQCPAKNLVVLLCRLMLVEVFMRYDTFTVESTKLFLGSSVTFTTLEKAT

SEQ ID NO: 157 - DNA, 1593 bp, Nicotiana tabacum
ccaaaaatggagcttcaatcttctcctttcaatttaatttctttgttcctcttcttttcttttcattttattctagtgaagaaatggaatgccaaaatcccaaagttacctccaggtccgtggaggcttccctttattggaagcctccatcacttgaagggaaaacttccacaccataatcttagagatctagcgcgaaaatatgggcctctcatgtacttacaactcggagaaattcctgtagttgtaatatcttcgccacgtgtagcaaaagctgtactaaaaactcatgatctcgcttttgcaactagaccacgattcatgtcctcagacattgtgttttacaaaagcagggacatctcttttgccccatttggtgattactggagacagatgcgtaaaatattgactcaggaactcctgagtaacaagatgctcaagtcatatagcttaatccgaaaggatgagctctcgaagctcctctcatcgattcgtttggaaacaggttctgcagtgaacataaatgaaaagcttctctggtttacgagctgcatgacctgtagattagcctttggaaaaatatgcaatgatcgggatgagttgatcatgctaattagggagatattaacattatcaggaggatttgatgtgggtgatttgttcccttcctggaaattacttcataatatgagcaacatgaaagctaggttgacgaatgtacaccacaagtatgatttagttatggagaacatcatcaatgagcaccaagagaatcatgcagcagggataaagggtaacaacgagtttggtggcgaagatatgatcgatgctctactgagggctaaggagaataatgagcttcaatttcctatcgaaaatgacaacatgaaagcagtaattctggacttgtttattgctggaactgaaacttcatatactgcaattatatgggcactatcagaattgatgaagcacccaagtgtgatggccaaggcacaagctgaagtgagaaaagtcttcaaagaaaatgaaaatttcgacgaaaatgatcttgacaagttgccatacttaaaatcagtgattaaagaaacactaaggatgcaccctccagttcctttgttagggcctagagaatgcagggaccaaacagagatcgatggctacactgtacctattaaagctagagttatggttaatgcttgggcgataggaagagatcctgaaagttgggaagatcctgaaagtttcaaaccggagcgatttgaaaatacttctgttgatcttacaggaaatcactatcagttcattcctttcggttcaggaagaagaatgtgtccaggaatgtcgtttggtttagttaacacagggcatcctttagcccagttgctctattgctttgactggaaactccctgacaaggttaatgcaaatgattttcgcactactgaaacaagtagagtttttgcagcaagcaaagatgacctctacttgattcccacaaatcacagggagcaagaatagcttaatttaatggagttcttggaagaattaaagaagaagggctatataggtgagattttttgtatggttgca

SEQ ID NO: 158 - protein, 504 aa, Nicotiana tabacum
MELQSSPFNLISLFLFFSFHFILVKKWNAKIPKLPPGPWRLPFIGSLHHLKGKLPHHNLRDLARKYGPLMYLQLGEIPVVVISSPRVAKAVLKTHDLAFATRPRFMSSDIVFYKSRDISFAPFGDYWRQMRKILTQELLSNKMLKSYSLIRKDELSKLLSSIRLETGSAVNINEKLLWFTSCMTCRLAFGKICNDRDELIMLIREILTLSGGFDVGDLFPSWKLLHNMSNMKARLTNVHHKYDLVMENIINEHQENHAAGIKGNNEFGGEDMIDALLRAKENNELQFPIENDNMKAVILDLFIAGTETSYTAIIWALSELMKHPSVMAKAQAEVRKVFKENENFDENDLDKLPYLKSVIKETLRMHPPVPLLGPRECRDQTEIDGYTVPIKARVMVNAWAIGRDPESWEDPESFKPERFENTSVDLTGNHYQFIPFGSGRRMCPGMSFGLVNTGHPLAQLLYCFDWKLPDKVNANDFRTTETSRVFAASKDDLYLIPTNHREQE

SEQ ID NO: 159 - DNA, 1599 bp, Nicotiana tabacum
cttcttccaaaaatggagcttcaatcttctcctttcaatttaatttctttgttcctcttcttttcttttctttttattctagtgaagaaatggaatgccaaaatcccaaagttacctccaggtccgtggaggcttccctttattggaagcctccatcacttgaagggaaaacttccacaccataatcttagagatctagcgcgaaaatatggacctctcatgtacttacaactcggagaaattcctgtagttgtaatatcttcgccacgtgtagcaaaagctgtactaaaaactcatgatctcgcttttgcaactagaccacgattcatgtcctcagacattgtgttttacaaaagcagggacatctcttttgccccatttggtgattactggagacagatgcgtaaaatattgactcaggaactcctgagtaacaagatgctcaagtcatatagcttaatccgaaaggatgagctctcgaagctcctctcatcgattcgtttggaaacaggttctgcagtgaacataaatgaaaagcttctctggtttacgagctgcatgacctgtagattagcctttggaaaaatatgcaatgatcgggatgagttgatcatgctaattagggagatattaacattatcaggaggatttgatgtgggtgatttgttcccttcctggaaattacttcataatatgagcaacatgaaagctaggttgacgaatgtacaccacaagtatgatttagttatggagaacatcatcaatgagcaccaagagaatcatgcagcagggataaagggtaacaacgagtttggtggcgaagatatgatcgatgctctactgagggctaaggagaataatgagcttcaatttcctatcgaaaatgacaacatgaaagcagtaattctggacttgtttattgctggaactgaaacttcatatactgcaattatatgggcactatcagaattgatgaagcacccaagtgtgatggccaaggcacaagctgaagtgagaaaagtcttcaaagaaaatgaaaatttcgacgaaaatgatcttgacaagttgccatacttaaaatcagtgattaaagaaacactaaggatgcaccctccagttcctttgttagggcctagagaatgcagggaccaaacagagatcgatggctacactgtacctattaaagctagagttatggttaatgcttgggcgataggaagagatcctgaaagttgggaagatcctgaaagtttcaaaccggagcgatttgaaaatacttctgttgatcttacaggaaatcactatcagttcattcctttcggttcaggaagaagaatgtgtccaggaatgtcgtttggtttagttaacacagggcatcctttagcccagttgctctattgctttgactggaaactccctgacaaggttaatgcaaatgattttcgcactactgaaacaagtagagtttttgcagcaagcaaagatgacctctacttgattcccacaaatcacagggagcaagaatagcttaatttaatggagttcttggaagaattaaagaagaagggctatataggtgagattttttgtatggttgca

SEQ ID NO: 160 - protein, 504 aa, Nicotiana tabacum
MELQSSPFNLISLFLFFSFLFILVKKWNAKIPKLPPGPWRLPFIGSLHHLKGKLPHHNLRDLARKYGPLMYLQLGEIPVVVISSPRVAKAVLKTHDLAFATRPRFMSSDIVFYKSRDISFAPFGDYWRQMRKILTQELLSNKMLKSYSLIRKDELSKLLSSIRLETGSAVNINEKLLWFTSCMTCRLAFGKICNDRDELIMLIREILTLSGGFDVGDLFPSWKLLHNMSNMKARLTNVHHKYDLVMENIINEHQENHAAGIKGNNEFGGEDMIDALLRAKENNELQFPIENDNMKAVILDLFIAGTETSYTAIIWALSELMKHPSVMAKAQAEVRKVFKENENFDENDLDKLPYLKSVIKETLRMHPPVPLLGPRECRDQTEIDGYTVPIKARVMVNAWAIGRDPESWEDPESFKPERFENTSVDLTGNHYQFIPFGSGRRMCPGMSFGLVNTGHPLAQLLYCFDWKLPDKVNANDFRTTETSRVFAASKDDLYLIPTNHREQE

SEQ ID NO: 161 - DNA, 1564 bp, Nicotiana tabacum
ctttctttcttgtaccgagatggagtttcaacacttggtttcgttcttgctattcatctccttcatctttcttctaattcaaaaatggaggaaatcgaaaaagctgccacctggtccgtggaggctacctattattggaagtgtgcatcacttgacaagtggagtaccacatcgagttctcagaaatttatcacaaaaatttggcccgatcatgtacttgcagctcggggaagttcccacagtagttgtatcctccccacacatggccaaacaaattttaaaaactcatgacctcgcttttgcatctaggccagaaatcatgatgggaaaaattatttgctacgattgtaaggacattgccttttccccgtatggtgattattggagacatatgcgtaaattgagcaccttggaactacttagtgccaagatggtcaagtccttcagtccaattcgtcaagatgagctctcaagtctcctatcatccattgaatcaatgggaaatttgccaatcaacttagtagaaaaacttttatggtttatgaatgccgcgacatgtaggtcagcatttgggaaagtgtgtaaagatcaaaaagagttgataacattgattcaacgagcagaatcattatctggtggattcgagctggctgatttgttcccttcgaagaagtttctacatggtattagtgggatgcgatctaaactaatggaagctcgtaacaagatagacgcagtcttggacaacattatcaatgtgcacagagagaatcgggcaaatggaaatagttgtaatggtgagtctggaactgtagatttcatcgatgtttttctaagggtcatggagagtggcgaattaccatttccgatagaaaatgacaacatcaaagcagttattcttgacatgttcgtagcaggatctgacacatcatcttcaaccgttatttgggcattaacagaaatgatgaagaatccaaaagtcatggctaaagcacaagctgaagtgagagaagcttttaaaggaaagaaagcatgtgatgaggatactgatcttgaaaagcttcattacctaaatttagtgatcaaagagacactccgattacaccctccaactcctctacttgtcccgcgagaatgcagggaggaaacagagatagaaggattcactataccattgaaaagcaaagtcttggttaacgtatgggcaattggaagagatcccgagaattggaaaaatcctgaatgttttataccagagagattcgaaaatagttctattgagtttactggaaatcattttcaacttcttccgtttggcgctggaagacgaatttgtccaggaatgcaatttggtttggctcttgttactctgccattggctcatttgcttcacaattttgattggaaacttcccgaaggaattaatgcaagggatttggacatgacagaggcaaatgggatatctgctagaagagaaaaagatctttacttgattgctactccttatgtatcacctcttgattaactctgaaattttgctttaatgctgcttgcttgcttcact

SEQ ID NO: 162 - protein, 501 aa, Nicotiana tabacum
MEFQHLVSFLLFISFIFLLIQKWRKSKKLPPGPWRLPIIGSVHHLTSGVPHRVLRNLSQKFGPIMYLQLGEVPTVVVSSPHMAKQILKTHDLAFASRPEIMMGKIICYDCKDIAFSPYGDYWRHMRKLSTLELLSAKMVKSFSPIRQDELSSLLSSIESMGNLPINLVEKLLWFMNAATCRSAFGKVCKDQKELITLIQRAESLSGGFELADLFPSKKFLHGISGMRSKLMEARNKIDAVLDNIINVHRENRANGNSCNGESGTVDFIDVFLRVMESGELPFPIENDNIKAVILDMFVAGSDTSSSTVIWALTEMMKNPKVMAKAQAEVREAFKGKKACDEDTDLEKLHYLNLVIKETLRLHPPTPLLVPRECREETEIEGFTIPLKSKVLVNVWAIGRDPENWKNPECFIPERFENSSIEFTGNHFQLLPFGAGRRICPGMQFGLALVTLPLAHLLHNFDWKLPEGINARDLDMTEANGISARREKDLYLIATPYVSPLD

SEQ ID NO: 163 - DNA, 1560 bp, Nicotiana tabacum
ctttcttgtaccgagatggagtttcaacacttggtttcgttcttgctattcatctccttcatctttcttctaattcaaaaatggaggaaatcgaaaaagctgccacctggtccgtggaggctacctattattggaagtgtgcatcacttgacaagtggagtaccacatcgagttctcagaaatttatcacaaaaatttggcccgatcatgtacttgcagctcggggaagttcccacagtagttgtatcctccccacacatggccaaacaaattttaaaaactcatgacctcgcttttgcatctaggccagaaatcatgatgggaaaaattatttgctacgattgtaaggacattgccttttccccgtatggtgattattggagacatatgcgtaaattgagcaccttggaactacttagtgccaagatggtcaagtccttcagtccaattcgtcaagatgagctctcaagtctcctatcatccattgaatcaatgggaaatttgccaatcaacttagtagaaaaacttttatggtttatgaatgccgcgacatgtaggtcagcatttgggaaagtgtgtaaagatcaaaaagagttgataacattgattcaacgagcagaatcattatctggtggattcgagctggctgatttgttcccttcgaagaagtttctacatggtattagtgggatgcgatctaaactaatggaagctcgtaacaagatagacgcagtcttggacaacattatcaatgtgcacagagagaatcgggcaaatggaaatagttgtaatggtgagtctggaactgtagatttcatcgatgtttttctaagggtcatggagagtggcgaattaccatttccgatagaaaatgacaacatcaaagcagttattcttgacatgttcgtagcaggatctgacacatcatcttcaaccgttatttgggcattaacagaaacgatgaagaatccaaaagtcatggctaaagcacaagctgaagtgagagaagcttttaaaggaaagaaagcatgtgatgaggatactgatcttgaaaagcatcattacctaaatttagtgatcaaagagacactccgattacaccctccaactcctctacttgtcccgcgagaatgcagggaggaaacagagatagaaggattcactataccattgaaaagcaaagtcttggttaacgtatgggcaattggaagagatcccgagaattggaaaaatcctgaatgttttataccagagagattcgaaaatagttctattgagtttactggaaatcattttcaacttcttccgtttggcgctggaagacgaatttgtccaggaatgcaatttggtttggctcttgttactctgccattggctcatttgcttcacaattttgattggaaacttcccgaaggaattaatgcaagggatttggacatgacagaggcaaatgggatatctgctagaagagaaaaagatctttacttgattgctactccttatgtatcacctcttgattaactctgaaattttgctttaatgctgcttgcttgcttcact

SEQ ID NO: 164 - protein, 501 aa, Nicotiana tabacum
MEFQHLVSFLLFISFIFLLIQKWRKSKKLPPGPWRLPIIGSVHHLTSGVPHRVLRNLSQKFGPIMYLQLGEVPTVVVSSPHMAKQILKTHDLAFASRPEIMMGKIICYDCKDIAFSPYGDYWRHMRKLSTLELLSAKMVKSFSPIRQDELSSLLSSIESMGNLPINLVEKLLWFMNAATCRSAFGKVCKDQKELITLIQRAESLSGGFELADLFPSKKFLHGISGMRSKLMEARNKIDAVLDNIINVHRENRANGNSCNGESGTVDFIDVFLRVMESGELPFPIENDNIKAVILDMFVAGSDTSSSTVIWALTETMKNPKVMAKAQAEVREAFKGKKACDEDTDLEKHHYLNLVIKETLRLHPPTPLLVPRECREETEIEGFTIPLKSKVLVNVWAIGRDPENWKNPECFIPERFENSSIEFTGNHFQLLPFGAGRRICPGMQFGLALVTLPLAHLLHNFDWKLPEGINARDLDMTEANGISARREKDLYLIATPYVSPLD

SEQ ID NO: 165 - DNA, 1552 bp, Nicotiana tabacum
caaaaacaaaattccaatggttaacatgttcactccaattatatacgctcctctccttttagctttttacattatcacaaaacatttcttacgcaaactcagaaataatccaccagctccatttcttactttcccctttattggccatctttatctcttcaaaaaaccacttcaacgtaccttagccaaaatctccgaacgttatggctctgttcttctactcgaattcggttcacgaaaagtacttttggtttcttcaccatctgcagctgaagaatgcttaacaaaaaacgatattattttcgcgaatcgtcctcttttgatggctggaaaacatcttggatataattttacatctttggcttggagttcgtacggagatcattggagaaatctgcgaaggattacttcagttgagatgttttcgactcatcgtcttcaaatgctacatgggattcgtattgatgaagtgaaatctatggttaagaggctcaattcctctgccatagctgaaaaatctgtggatatgaagtctatgttttttgagctgatgctcaatgttatgatgaggacaattgctggaaaaagatattacggtgagaatgtggaggacattgaggaagctacgagattcaaaggtttggtgcaagagactttcaggattggcggggcgacgaatattggcgactttttgccggcgttgaagttattggtgaggaaattggagaaaagtttaattgtgttgcaagagaacagagatgagtttatgcaggaattaattaaagattgcagaaaaagaatggagaaagaaggtactgttactgattcagaaattgaagggaacaagaaatgtttaattgaagttttgttaacactacaagaaaatgaaccggaatactacaaagatgaaatcatcagaagccttatgcttgttctattatcagctggtacagatacttcagttgggacaatggaatgggctttatcattaatgttaaaccaccctgaaactctgaagaaagcacaagctgaaattgatgaacatataggacatgaacgtttagtggacgagtcggacatcaacaacctaccttacctacgttgtataatcaacgagacattccgaatgtaccctgcaggaccactactagtcccacacgagtcgtcagaggaaaccaccgtaggaggctaccgtgtacccggaggaaccatgttacttgtgaatttgtgggcaattcacaatgatccaaagctatgggatgaaccaagaaagtttaaaccagaaagatttcaaggactagatggtgttagagatggttacaaaatgatgccttttggttctggacgaaggagttgtcctggagaaggattggctgttcgaatggttgccttgtcattgggatgtattattcaatgttttgattggcaacgaatcggcgaagaattggttgatatgactgaaggaactggacttactttgcctaaagctcaacctttggtggccaagtgtagcccacgacctaaaatggctaatcttctctctcagatttga

SEQ ID NO: 166 - protein, 511 aa, Nicotiana tabacum
MVNMFTPIIYAPLLLAFYIITKHFLRKLRNNPPAPFLTFPFIGHLYLFKKPLQRTLAKISERYGSVLLLEFGSRKVLLVSSPSAAEECLTKNDIIFANRPLLMAGKHLGYNFTSLAWSSYGDHWRNLRRITSVEMFSTHRLQMLHGIRIDEVKSMVKRLNSSAIAEKSVDMKSMFFELMLNVMMRTIAGKRYYGENVEDIEEATRFKGLVQETFRIGGATNIGDFLPALKLLVRKLEKSLIVLQENRDEFMQELIKDCRKRMEKEGTVTDSEIEGNKKCLIEVLLTLQENEPEYYKDEIIRSLMLVLLSAGTDTSVGTMEWALSLMLNHPETLKKAQAEIDEHIGHERLVDESDINNLPYLRCIINETFRMYPAGPLLVPHESSEETTVGGYRVPGGTMLLVNLWAIHNDPKLWDEPRKFKPERFQGLDGVRDGYKMMPFGSGRRSCPGEGLAVRMVALSLGCIIQCFDWQRIGEELVDMTEGTGLTLPKAQPLVAKCSPRPKMANLLSQI

SEQ ID NO: 167 - DNA, 1675 bp, Nicotiana tabacum
caaaaacaaaattccaatggttaacatgttcactccaattatatacgctcctctccttttagctttttacattatcacaaaacatttcttacgcaaactcagaaataacccaccagctccatttcttactttcccctttattggccatctttatctcttcaaaaaaccacttcaacgtaccttagccaaaatctccgaacgttatggctctgttcttctactcgaattcggttcacgaaaagtacttttggtttcttcaccatctgcagctgaagaatgcttaacaaaaaacgatattattttcgcgaatcgtcctcttttgatggctggaaaacatcttggatataattttacttctttggcttggagttcgtacggagatcactggagaaatcttcgtaggattacttcagttgagatgttttcgactcatcgtcttcaaatgctacatggaattcgtattgatgaagtgaaatctatggttaagaggctcaattcctctgccatagctgaaaaatctgtggatatgaagtctatgttttttgagctgatgctcaatgttatgatgaggacaattgctggaaaaagatattacggtgagaatgtggaggacattgaggaagctacgagattcaaaggtttggtgcaagagactttcaggattggcggggcgacgaatattggcgactttttgccggcgttgaagttattggtgaggaaattggagaaaagtttaattgtgttgcaagagaacagagatgagtttatgcaggaattaattaaagattgcagaaaaagaatggagaaagaaggtactgttactgattcagaaattgaagggaacaagaaatgtttaattgaagttttgttaacactacaagaaaatgaaccggaatactacaaagatgaaatcatcagaagccttatgcttgttctattatcagctggtacagatacttcagttgggacaatggaatgggctttatcattaatgttaaaccaccctgaaactctgaagaaagcacaagctgaaattgatgaacatataggacatgaacgtttagtggacgagtcggacatcaacaacctaccttacctacgttgtataatcaacgagacattccgaatgtaccctgcaggaccactactagtcccacacgagtcgtcagaggaaaccaccgtaggaggctaccgtgtacccggaggaaccatgttacttgtgaatttgtgggctattcacaatgatccaaagctatgggatgaaccaagaaagtttaagccagaaagatttgaaggactagaaggtgttagagacggttacaaaatgatgccttttggttctggacgaaggagttgtcctggagaaggattggctattcgaatggttgcattgtcattgggatgtattattcaatgctttgattggcaacgacttggggaaggattggttgataagactgaaggaactggacttactttgcctaaagctcaacctttagtggccaagtgtagcccacgacctataatggctaatcttctttctcagatttgaacataattggtttctaccaaacatccccaaactagaatattattattggttacatatacaatgtaatcaattttgaaccatattatatctcaatgtattcctttttaaaaaaaaaaaaaaaaa

SEQ ID NO: 168 - protein, 511 aa, Nicotiana tabacum
MVNMFTPIIYAPLLLAFYIITKHFLRKLRNNPPAPFLTFPFIGHLYLFKKPLQRTLAKISERYGSVLLLEFGSRKVLLVSSPSAAEECLTKNDIIFANRPLLMAGKHLGYNFTSLAWSSYGDHWRNLRRITSVEMFSTHRLQMLHGIRIDEVKSMVKRLNSSAIAEKSVDMKSMFFELMLNVMMRTIAGKRYYGENVEDIEEATRFKGLVQETFRIGGATNIGDFLPALKLLVRKLEKSLIVLQENRDEFMQELIKDCRKRMEKEGTVTDSEIEGNKKCLIEVLLTLQENEPEYYKDEIIRSLMLVLLSAGTDTSVGTMEWALSLMLNHPETLKKAQAEIDEHIGHERLVDESDINNLPYLRCIINETFRMYPAGPLLVPHESSEETTVGGYRVPGGTMLLVNLWAIHNDPKLWDEPRKFKPERFEGLEGVRDGYKMMPFGSGRRSCPGEGLAIRMVALSLGCIIQCFDWQRLGEGLVDKTEGTGLTLPKAQPLVAKCSPRPIMANLLSQI

SEQ ID NO: 169 - DNA, 1755 bp, Nicotiana tabacum
caacacgcttactatctcctaaatctccactcaaaaacaaagaagagaaagatttaaaactaataattatgaaagagatggtgcaaaacaatatgagcacttctcttcttgaaactttacaagctacgcccatgatattctacttcatcgtccctctcttctgcttattccttctctccaaatctcgccgtaaacgtttgcctccaggtccaactggctggcctctcattggtaacatgatgatgatggaccagttaactcaccgtggccttgccaaactagcccaaaaatatggtggtgtttttcaccttaaaatgggttatgttcacaaaattgtagtctctggtccagacgaagctcgccaagtattacaggaacacgacatcatattttcgaaccgtccagcgaccgtagccataagttacctaacatatgacagggcagacatggcttttgctgactatggactcttctggcggcagatgagaaaactatgtgtaatgaaactcttcagccgcaaacgagctgagtcatgggactcagttcgagacgaagcggattccatggttagaattgtaacaaccaacacaggcacagctgttaacttaggtgaacttgttttcagtctcactcgtaatattatctacagagctgcttttggaacttgttctgaagatggacaaggcgagttcattaaaattatgcaagagttttcgaagctatttggtgctttcaatatagctgattttattccatggctagggtgggttggtaagcagagtctaaatattagacttgctaaggctagagcgtcgcttgatgggttcattgattcgattattgatgaccatattattagaaagaaagcttatgttaatggcaaaaatgatggaggtgatcgagaaactgatatggtggatgagcttttagctttttacagtgaggaagcaaaagtaactgagtccgaagatttgcagaatgctatcagacttactaaggataatatcaaagctatcatcatggatgtaatgtttggagggacagaaacagtggcttctgcaatagaatgggccatggcagagcttatgaggagtcctgaagatcttaaaaaggtacaacaagagctggctaacgttgttggactcaacagaaaagttgaagaatctgactttgaaaaattaacatacttaagatgttgtctaaaagaaactctacgacttcaccctccaatccctctcctcctccatgagaccgccgaggaatccaccgtctccggctaccatattccggcaaagtcacatgttattataaattcatttgccattgggcgtgacaaaaattcatgggaagatcctgaaacttataaaccatctaggtttctcaaagaaggtgtaccagattttaaaggaggtaattttgagtttataccatttgggtcgggtcggcggtcttgccccggtatgcaacttgggctttatgcattggaaatggctgtggcccatcttcttcattgttttacttgggaattgccagatggtatgaaaccaagtgagcttaaaatggatgatatttttggactcactgctccaagagctaatcgactcgtggctgtgcctactccacgtttgttgtgtcccctttattaattgaagaaaaaaggtggggcttttacttgcatcaaagagtggtgcttgtgatttttccaccttttggttaaatatacgaattattatgatatacgaattcttgggcaca

SEQ ID NO: 170 - protein, 525 aa, Nicotiana tabacum
MKEMVQNNMSTSLLETLQATPMIFYFIVPLFCLFLLSKSRRKRLPPGPTGWPLIGNMMMMDQLTHRGLAKLAQKYGGVFHLKMGYVHKIVVSGPDEARQVLQEHDIIFSNRPATVAISYLTYDRADMAFADYGLFWRQMRKLCVMKLFSRKRAESWDSVRDEADSMVRIVTTNTGTAVNLGELVFSLTRNIIYRAAFGTCSEDGQGEFIKIMQEFSKLFGAFNIADFIPWLGWVGKQSLNIRLAKARASLDGFIDSIIDDHIIRKKAYVNGKNDGGDRETDMVDELLAFYSEEAKVTESEDLQNAIRLTKDNIKAIIMDVMFGGTETVASAIEWAMAELMRSPEDLKKVQQELANVVGLNRKVEESDFEKLTYLRCCLKETLRLHPPIPLLLHETAEESTVSGYHIPAKSHVIINSFAIGRDKNSWEDPETYKPSRFLKEGVPDFKGGNFEFIPFGSGRRSCPGMQLGLYALEMAVAHLLHCFTWELPDGMKPSELKMDDIFGLTAPRANRLVAVPTPRLLCPLY

SEQ ID NO: 171 - DNA, 1684 bp, Nicotiana tabacum
tgtgcttgtgagtgtgggagaaggccttcaatatggagataccatattacagcttaaaaattgcaatttcttcatttgcaattatctttgtactaagatgggcatggaaaatcttgaattatgtgtggttaaaaccaaaagaattggagaaatacctcagacagcagggtttcaaaggaaactcttacaaattcttgtttggggatatgaaagagatgaagaaaatgggtgaagaagctatgtctaagccaatcaatttctctcatgacatgatttggcctagagttatgccattcatccacaaaaccatcaccaattatggtaagaattgtattgtgtggtttgggccaagaccagcagtcctgatcacagacccggaacttgtaaaggaggtgctaacgaagaatttcgtctatcagaagccgcttggcaatccactcacaaagttggcagcaactggaattgcaggctatgaaacagataaatgggctacacatagaaggcttctcaatcctgcttttcaccttgacaagttgaagcatatgctacctgcattccaatttactgctagtgagatgttgagcaaattggagaaagttgtttcaccaaacggaacagagatagatgtgtggccatatttacaaactttgacaagtgatgccatttcaagaactgcgtttggaagtagttatgaagaaggaagaaagatttttgaccttcaaaaagaacaactttcactaattctagaagtttcacgcacaatatatattccaggatggaggtttttgccaacgaaaaggaacaaaaggatgaagcaaatatttaatgaagtacgagcactggtatttggaattattaagaaaaggatgagtatgattgaaaatggagaagcacctgatgatttattgggaatattattggcatccaatttaaaagaaatccaacaacatggaaacaacaagaaatttggtatgagtattgatgaggtgattgaagagtgtaaactcttctattttgctgggcaagagactacttcatctttacttgtatggactatgattttgttgtgcaaatatcctaattggcaagataaagctagagaagaggttttgcaagtgtttgggagtagggaagttgactatgacaagttgaatcagctaaaaatagtaactatgatcttaaacgaggtcttaaggttgtatccagcaggatatgtgattaatcgaatggtaaacaaagaaacaaagttagggaatttgtgtttaccagccggcgtacagctcgtgttaccaacaatgttgttgcaacatgatactgaaatatggggagatgatgcaatggagttcaatccagagagatttagtgatggaatatccaaagcaacaaaaggaaaacttgtgttttttccatttagttggggtccaagaatatgtattgggcaaaattttgctatgttagaggctaaaatggcaatggctatgattctgaaaacctatgcatttgaactctctccatcttatgctcatgctcctcatccactactacttcaacctcaatatggtgctcaattaattttgtacaagttgtagatatggtcaatttggaacttgttatggaacttttatcattgtaatcaaccatattgagggaacatggtttgaggttaaatcctcgtgtgtgtgtc

SEQ ID NO: 172 - protein, 518 aa, Nicotiana tabacum
MEIPYYSLKIAISSFAIIFVLRWAWKILNYVWLKPKELEKYLRQQGFKGNSYKFLFGDMKEMKKMGEEAMSKPINFSHDMIWPRVMPFIHKTITNYGKNCIVWFGPRPAVLITDPELVKEVLTKNFVYQKPLGNPLTKLAATGIAGYETDKWATHRRLLNPAFHLDKLKHMLPAFQFTASEMLSKLEKVVSPNGTEIDVWPYLQTLTSDAISRTAFGSSYEEGRKIFDLQKEQLSLILEVSRTIYIPGWRFLPTKRNKRMKQIFNEVRALVFGIIKKRMSMIENGEAPDDLLGILLASNLKEIQQHGNNKKFGMSIDEVIEECKLFYFAGQETTSSLLVWTMILLCKYPNWQDKAREEVLQVFGSREVDYDKLNQLKIVTMILNEVLRLYPAGYVINRMVNKETKLGNLCLPAGVQLVLPTMLLQHDTEIWGDDAMEFNPERFSDGISKATKGKLVFFPFSWGPRICIGQNFAMLEAKMAMAMILKTYAFELSPSYAHAPHPLLLQPQYGAQLILYKL

SEQ ID NO: 173 - DNA, 1697 bp, Nicotiana tabacum
ccagcaccaagacatggagaattcctgggtagttttagccttaacaggccttcttacattagtttttctctcaaagtttcttcatagtcctcgtcgtaaacaaaatcttccaccaggtccaaaaccatggcctattgttggcaatatacatcttcttggttccacccctcacagatcccttcacgaacttgcaaaaagatacggagatttaatgctactaaagttcggttcgcgcaatgtccttattttatcctccccagatatggctagagaattcttgaaaacaaatgatgccatttgggcttctcgccctgagcttgccgctggtaaatatactgcttataattattgcgacatgacatgggcacgttatggacccttttggagacaagcaaggaggatctatctcaacgagattttcaatcctaaacgtttggattcatttgagtacattcgcatagaggaaaggcataatttgatttcacgtctttttgttctctctgggaagccaattcttcttagagaccatttaactcggtacactcttacaagtataagtagaacagtattgagtggaaaatattttagcgagtcacctggccaaaattcaatgataactttgaaacaattgcaggatatgcttgataagtggtttttgcttaatggtgtgatcaatattggggactggataccttggcttgctttcttggatttgcagggttatgtcaagcaaatgaaggagttgcataggaacttcgacaaatttcataactttgtgctagatgatcacaaggctaataggggagagaagaactttgtgccaagagacatggtcgatgttttgctgcagcaagctgaggatcctaatcttgaggtcaaactcaccaatgattgtgtcaagggtctaatgcaggacttattggctggcggcacggacacctcagcaacaaccgttgaatgggctttttatgaacttcttagacaacctaagattatgaagaaagcacaacaagagctagaccttgtcatttcacaggacagatgggttcaagaaaaagattacactcaactcccttacattgagtcaatcatcaaggaaacattgaggcttcacccagtaagcaccatgcttccaccgcgcattgccttggaggattgtcatgtagcaggctatgacatacctaaaggtacaattttaattgtgaacacttggagtattggaagaaattcacagcattgggagtcaccagaagaattccttccggagaggtttgaagggaagaatattggtgtcacaggacaacattttgcgctcttgccatttggcgcgggccggagaaagtgcccaggatacagtcttgggattcgtataattagggcaactttagctaacttgttgcatggattcaactggagattgcctaatggtatgagtccagaagacattagcatggaagagatttatgggctaattacacaccccaaagtcgcacttgacgtgatgatggagcctcgacttcccaaccatctttacaaatagtggataattaaaaccattaaaatcgttttgttatatgcatgtctcatatttgtagtggtcaaaatgtttgttttctatcatggatgttcagtgcgaggttgggaatttcaagtcattaacgtgtgaaaatattttaaatttaaaaaaaaaaaaaaaa

SEQ ID NO: 174 - protein, 508 aa, Nicotiana tabacum
MENSWVVLALTGLLTLVFLSKFLHSPRRKQNLPPGPKPWPIVGNIHLLGSTPHRSLHELAKRYGDLMLLKFGSRNVLILSSPDMAREFLKTNDAIWASRPELAAGKYTAYNYCDMTWARYGPFWRQARRIYLNEIFNPKRLDSFEYIRIEERHNLISRLFVLSGKPILLRDHLTRYTLTSISRTVLSGKYFSESPGQNSMITLKQLQDMLDKWFLLNGVINIGDWIPWLAFLDLQGYVKQMKELHRNFDKFHNFVLDDHKANRGEKNFVPRDMVDVLLQQAEDPNLEVKLTNDCVKGLMQDLLAGGTDTSATTVEWAFYELLRQPKIMKKAQQELDLVISQDRWVQEKDYTQLPYIESIIKETLRLHPVSTMLPPRIALEDCHVAGYDIPKGTILIVNTWSIGRNSQHWESPEEFLPERFEGKNIGVTGQHFALLPFGAGRRKCPGYSLGIRIIRATLANLLHGFNWRLPNGMSPEDISMEEIYGLITHPKVALDVMMEPRLPNHLYK

SEQ ID NO: 175 - DNA, 1631 bp, Nicotiana tabacum
actgttcaaatcacagtaacagcatcttgtgctgccataataattactctagtggtgtgtatatggagagtgctgaattgggtttggttcagaccaaagaagctggaaaagctactgaggaaacaaggtctcaaaggcaattcctacaggattttgtatggggatatgaaggagctttctggtatgattaaggaagctaactccaaacccatgaatctttctgatgatattgccccaagattggtccctttctttcttgataccatcaagaaatatgggaaaaaatcctttgtatggttgggtccaaaaccgctggtttttgtcatggaccccgagcttataaaggaagtattctccaaaaactatctgtatcaaaagcctcattcaaatccattaaccaagttactggcacaaggacttgtaagccaagaggaagacaaatgggccaaacatagaaaaatcgtcactcctgccttccacctggagaagctaaagcatatgcttccagctttttgtttgagctgtactgagatgctgagcaaatgggaagacattgttgcagttgagggctcacatgagatagatatatggcctggccttcaacaattaactagtgatgtgatctctcggacagcctttggcagtagctatgaagcaggtagaaggatatttgaacttcaaaaggaacaagctcaatttcttatggaagctatacgctccgtttatattccaggctggaggtttttgccaacaaagaggaacagaagaatgaaggaaattgaaaaggatgttcaagccttagttagaggtattattgataaaagagtaaagtcaatgaaagcaggagaggtgaataatgaggatctgcttggtatattgctggaatctaattttaaagaaattgaacagcatggaaacaaggattttggaatgagcattgaagaagtcattcaagaatgcaagttattctattttgctggccaagaaactacatcagtgttgcttgtatggactctaatattgctgagcaggcatcaggattggcaagcactggccagagaagaggtgttgcaagtctttgggaatcagaaaccagattttgatggattaaatcgtctaaaaattgttacaatgatcttgtacgagtctttaaggctctatcccccagtagtgacacttacccgaaggcctaaggaagacactgtattaggagatgtatctctaccagcaggtgtgttaatctccttaccagtgatcttattgcatcacgacgaagagatatggggtaaagatgcaaagaagttcaagccagagagattcagagatggagtctcaagtgcaacaaagggtcaagtcacttttttcccatttacttggggtcccagaatatgcattggacaaaattttgccatgttagaagcaaagactactttggctatgatcctacaacgcttctcctttgaactgtctccatcttatgcacatgctcctcagtccataataactttgcaaccccagtatggtgctccacttattttgcataaaatatagtttattacttgtaagtagtgtctcgttttatgttaagcatgagtccaaaatgttaaggcttgtagaactgcaaaatggga

SEQ ID NO: 176 - protein, 461 aa, Nicotiana tabacum
MKELSGMIKEANSKPMNLSDDIAPRLVPFFLDTIKKYGKKSFVWLGPKPLVFVMDPELIKEVFSKNYLYQKPHSNPLTKLLAQGLVSQEEDKWAKHRKIVTPAFHLEKLKHMLPAFCLSCTEMLSKWEDIVAVEGSHEIDIWPGLQQLTSDVISRTAFGSSYEAGRRIFELQKEQAQFLMEAIRSVYIPGWRFLPTKRNRRMKEIEKDVQALVRGIIDKRVKSMKAGEVNNEDLLGILLESNFKEIEQHGNKDFGMSIEEVIQECKLFYFAGQETTSVLLVWTLILLSRHQDWQALAREEVLQVFGNQKPDFDGLNRLKIVTMILYESLRLYPPVVTLTRRPKEDTVLGDVSLPAGVLISLPVILLHHDEEIWGKDAKKFKPERFRDGVSSATKGQVTFFPFTWGPRICIGQNFAMLEAKTTLAMILQRFSFELSPSYAHAPQSIITLQPQYGAPLILHKI

SEQ ID NO: 177 - DNA, 1572 bp, Nicotiana tabacum
atttatctctgaaaatgcaattcttcagcttggtttccattttcctattcctatctttcctatttttgttgaggaaatggaagaactccaatagccaaagcaaaaaattgccaccaggtccatggaaaataccaatactaggaagtatgcttcatatgattggtggagaaccgcaccatgtccttagagatttagccaaaaaagatggaccacttatgcaccttcagttaggtgaaatttctgcagttgtggttacttctagggacatggcaaaagaagtgctaaaaactcatgacgtcgtttttgcatctaggcctaaaattgtagccatggacattatctgttataaccagtccgacattgcctttagcccttatggcgaccactggagacaaatgcgtaaaatttgtgtcatggaacttctcaatgcaaagaatgttcggtctttcagctccatcagacgtgatgaagtcgttcgtctcattgactctatccggtcagattcttcttcaggtgagctagttaattttacgcagaggatcatttggtttgcaagctccatgacgtgtagatcagcatttgggcaagtactcaaggggcaagacatatttgccaaaaagatcagagaagtaataggattagcagaaggctttgatgtggtagacatcttccctacatacaagtttcttcatgttctcagtgggatgaagcgtaaacttttgaatgcccaccttaaggtagacgccattgttgaggatgtcatcaacgagcacaagaaaaatcttgcagctggcaagagtaatggcgcattaggaggcgaagatctaattgatgtcctactgagacttatgaatgacacaagtcttcaatttcccatcaccaacgacaatatcaaagctgttgttgttgacatgtttgctgccggaacagaaacttcatcaacaacaactgtatgggccatggctgaaatgatgaagaatccaagtgtattcgccaaagctcaagcagaagtgcgagaagcctttagggacaaagtatcttttgatgaaaatgatgtggaggagctgaaatacttaaagttagtcattaaagaaactttgagacttcatccaccgtctccacttttggtcccaagagaatgcagggaagatacggatataaacggctacactattcctgcaaagaccaaagttatggttaatgtttgggcattgggaagagatccaaaatattgggatgacgcggaaagctttaagccagagagatttgagcaatgttctgtagatatttttggtaataattttgagtttcttccctttggcgggggacggagaatttgtcctggaatgtcatttggtttagctaatctttacttaccattggctcaattactctatcactttgactggaaactcccaaccggaatcaagccaagagacttggacttgaccgaattatcgggaataactattgctagaaagggtgacctttacttaaatgctactccttatcaaccttctcgagagtaatttactattggcataaacattttaaatttccttcatcaacctc

SEQ ID NO: 178 - protein, 504 aa, Nicotiana tabacum
MQFFSLVSIFLFLSFLFLLRKWKNSNSQSKKLPPGPWKIPILGSMLHMIGGEPHHVLRDLAKKDGPLMHLQLGEISAVVVTSRDMAKEVLKTHDVVFASRPKIVAMDIICYNQSDIAFSPYGDHWRQMRKICVMELLNAKNVRSFSSIRRDEVVRLIDSIRSDSSSGELVNFTQRIIWFASSMTCRSAFGQVLKGQDIFAKKIREVIGLAEGFDVVDIFPTYKFLHVLSGMKRKLLNAHLKVDAIVEDVINEHKKNLAAGKSNGALGGEDLIDVLLRLMNDTSLQFPITNDNIKAVVVDMFAAGTETSSTTTVWAMAEMMKNPSVFAKAQAEVREAFRDKVSFDENDVEELKYLKLVIKETLRLHPPSPLLVPRECREDTDINGYTIPAKTKVMVNVWALGRDPKYWDDAESFKPERFEQCSVDIFGNNFEFLPFGGGRRICPGMSFGLANLYLPLAQLLYHFDWKLPTGIKPRDLDLTELSGITIARKGDLYLNATPYQPSRE

SEQ ID NO: 179 - DNA, 1633 bp, Nicotiana tabacum
ataatgctttctcccatagaagccattgtaggactagtaaccttcacatttctcttcttcttcctatggacaaaaaaatctcaaaaaccttcaaaacccttaccaccgaaaatccccggaggatggccggtaatcggccatcttttccacttcaatgacgacggcgacgaccgtccattagctcgaaaactcggagacttagctgacaaatacggccccgttttcacttttcggctaggccttccccttgtcttagttgtaagcagttacgaagctgtaaaagactgtttctctacaaatgacgccattttttccaatcgtccagcttttctttacggcgattaccttggctacaataatgccatgctatttttggccaattacggaccttactggcgaaaaaatcgaaaattagttattcaggaagttctctccgctagtcgtctcgaaaaattcaaacacgtgagatttgcaagaattcaagcgagcattaagaatttatatactcgaattgatggaaattcgagtacgataaatttaactgattggttagaagaattgaattttggtctgatcgtgaagatgatcgctggaaaaaattatgaatccggtaaaggagatgaacaagtggagagatttaagaaagcgtttaaggattttatgattttatcaatggagtttgtgttatgggatgcatttccaattccattatttaaatgggtggattttcaagggcatgttaaggctatgaaaaggacttttaaagatatagattctgtttttcagaattggttaggggaacatattaataaaagagaaaaaatggaggttaatgcagaagggaatgaacaagatttcattgatgtggtgctttcaaaaatgagtaatgaatatcttggtgaaggttactctcgtgatactgtcattaaagcaacggtgtttagtttggtcttggatgcagcagacacagttgctcttcacataaattggggaatggcattattgataaacaatcaaaaggccttgacgaaagcacaagaagagatagacacaaaagttggtaaggacagatgggtagaagagagtgatattaaggatttggtatacctccaagctattgttaaagaagtgttacgattatatccaccaggacctttgttagtaccacacgaaaatgtagaagattgtgttgttagtggatatcacattcctaaagggacaagattattcgcaaacgtcatgaaactgctacgtgatcctaaactctggcctgatcctgatactttcgatccagagagattcattgctactgatattgactttcgtggtcagtactataagtatatcccgtttggttctggaagacgatcttgtccagggatgacttatgcattgcaagtggaacacttaacaatggcacatttgatccaaggtttcaattacagaactccaaatgacgagcccttggatatgaaggaaggtgcaggcataactatacgtaaggtaaatcctgtggaactgataatagcgcctcgcctggcacctgagctttattaaaacctaagatctttcatcttggttgatcattgtataatactcctaaatggatattcatttaccttttatcaattaa

SEQ ID NO: 180 - protein, 517 aa, Nicotiana tabacum
MLSPIEAIVGLVTFTFLFFFLWTKKSQKPSKPLPPKIPGGWPVIGHLFHFNDDGDDRPLARKLGDLADKYGPVFTFRLGLPLVLVVSSYEAVKDCFSTNDAIFSNRPAFLYGDYLGYNNAMLFLANYGPYWRKNRKLVIQEVLSASRLEKFKHVRFARIQASIKNLYTRIDGNSSTINLTDWLEELNFGLIVKMIAGKNYESGKGDEQVERFKKAFKDFMILSMEFVLWDAFPIPLFKWVDFQGHVKAMKRTFKDIDSVFQNWLGEHINKREKMEVNAEGNEQDFIDVVLSKMSNEYLGEGYSRDTVIKATVFSLVLDAADTVALHINWGMALLINNQKALTKAQEEIDTKVGKDRWVEESDIKDLVYLQAIVKEVLRLYPPGPLLVPHENVEDCVVSGYHIPKGTRLFANVMKLLRDPKLWPDPDTFDPERFIATDIDFRGQYYKYIPFGSGRRSCPGMTYALQVEHLTMAHLIQGFNYRTPNDEPLDMKEGAGITIRKVNPVELIIAPRLAPELY

SEQ ID NO: 181 - DNA, 1585 bp, Nicotiana tabacum
aatccataatgctttctcccatagaagccattgtaggactagtaaccttcacatttctcttcttcttcctatggacaaaaaaatctcaaaaaccttcaaaacccttaccaccgaaaatccccggaggatggccggtaatcggccatcttttccacttcaatgacgacggcgacgaccgtccattagctcgaaaactcggagacttagctgacaaatacggccccgttttcacttttcggctaggccttccccttgtcttagttgtaagcagttacgaagctgtaaaagactgtttctctacaaatgacgccattttttccaatcgtccagcttttctttacggcgattaccttggctacaataatgccatgctatttttggccaattacggaccttactggcgaaaaaatcgaaaattagttattcaggaagttctctccgctagtcgtctcgaaaaattcaaacacgtgagatttgcaagaattcaagcgagcattaagaatttatatactcgaattgatggaaattcgagtacgataaatttaactgattggttagaagaattgaattttggtctgatcgtgaagatgatcgctggaaaaaattatgaatccggtaaaggagatgaacaagtggagagatttaagaaagcgtttaaggattttatgattttatcaatggagtttgtgttatgggatgcatttccaattccattatttaaatgggtggattttcaagggcatgttaaggctatgaaaaggacttttaaagatatagattctgtttttcagaattggttagaggaacatattaataaaagagaaaaaatggaggttaatgcagaagggaatgaacaagatttcattgatgtggtgctttcaaaaatgagtaatgaatatcttggtgaaggttactctcgtgatactgtcattaaagcaacggtgtttagtttggtcttggatgcagcagacacagttgctcttcacataaattggggaatggcattattgataaacaatcaaaaggccttgacgaaagcacaagaagagatagacacaaaagttggtaaggacagatgggtagaagagagtgatattaaggatttggtatacctccaagctattgttaaagaagtgttacgattatatccaccaggacctttgttagtaccacacgaaaatgtagaagattgtgttgttagtggatatcacattcctaaagggacaagattattcgcaaacgtcatgaaactgcaacgtgatcctaaactctggtctgatcctgatactttcgatccagagagattcattgctactgatattgactttcgtggtcagtactataagtatatcccgtttggttctggaagacgatcttgtccagggatgacttatgcattgcaagtggaacacttaacaatggcacatttgatccaaggtttcaattacagaactccaaatgacgagcccttggatatgaaggaaggtgcaggcataactatacgtaaggtaaatcctgtggaactgataatagcgcctcgcctggcacctgagctttattaaaacctaagatcatcttgcttgat

SEQ ID NO: 182 - protein, 517 aa, Nicotiana tabacum
MLSPIEAIVGLVTFTFLFFFLWTKKSQKPSKPLPPKIPGGWPVIGHLFHFNDDGDDRPLARKLGDLADKYGPVFTFRLGLPLVLVVSSYEAVKDCFSTNDAIFSNRPAFLYGDYLGYNNAMLFLANYGPYWRKNRKLVIQEVLSASRLEKFKHVRFARIQASIKNLYTRIDGNSSTINLTDWLEELNFGLIVKMIAGKNYESGKGDEQVERFKKAFKDFMILSMEFVLWDAFPIPLFKWVDFQGHVKAMKRTFKDIDSVFQNWLEEHINKREKMEVNAEGNEQDFIDVVLSKMSNEYLGEGYSRDTVIKATVFSLVLDAADTVALHINWGMALLINNQKALTKAQEEIDTKVGKDRWVEESDIKDLVYLQAIVKEVLRLYPPGPLLVPHENVEDCVVSGYHIPKGTRLFANVMKLQRDPKLWSDPDTFDPERFIATDIDFRGQYYKYIPFGSGRRSCPGMTYALQVEHLTMAHLIQGFNYRTPNDEPLDMKEGAGITIRKVNPVELIIAPRLAPELY

SEQ ID NO: 183 - DNA, 1620 bp, Nicotiana tabacum
ctaaaactccataatggtttctcccgtagaagccattgtaggactagtaacccttacacttctcttctacttcctatggcccaaaaaatttcaaataccttcaaaaccattaccaccgaaaattcccggagggtggccggtaatcggccatcttttctacttcgatgatgacggcgacgaccgtccattagctcgaaaactcggagacttagctgacaaatacggcccggttttcactttccggctaggccttccgcttgtgttaattgtaagcagttacgaagctgtaaaagactgcttctctacaaatgacgccattttctccaatcgtccagcttttctttacggtgaataccttggctacaataatgccatgctatttttgacaaaatacggaccttattggcgaaaaaatagaaaattagtcattcaggaagttctctctgctagtcgtctcgaaaaattgaagcacgtgagatttggtaaaattcaaacgagcattaagagtttatacactcgaattgatggaaattcgagtacgataaatctaactgattggttagaagaattgaattttggtctgatcgtgaaaatgatcgctgggaaaaattatgaatccggtaaaggagatgaacaagtggagagatttaggaaagcgtataaggattttataattttatcaatggagtttgtgttatgggatgcttttccaattccattgttcaaatgggtggattttcaaggctatgttaaggccatgaaaaggacatttaaggatatagattctgtttttcagaattggttagaggaacatgtcaagaaaagagaaaaaatggaggttaatgcacaagggaatgaacaagatttcattgatgtggtgctttcaaaaatgagtaatgaatatcttgatgaaggttactctcgtgatactgtcataaaagcaacagtgtttagtttggtcttggatgctgcggacacagttgctcttcacatgaattggggaatggcattactgataaacaatcaacatgccttgaagaaagcacaagaagagatcgataagaaagttggtaaggaaagatgggtagaagagagtgatattaaggatttggtctacctccaagctattgttaaagaagtgttacgattatatccaccaggacctttattagtacctcatgaaaatgtagaggattgtgttgttagtggatatcacattcctaaagggactagactattcgcgaacgttatgaaattgcagcgcgatcctaaactctggtcaaatcctgataagtttgatccagagagattcttcgctgatgatattgactaccgtggtcagcactatgagtttatcccatttggttctggaagacgatcttgtccggggatgacttatgcattacaagtggaacacctaacaatagcacatttgatccagggtttcaattacaaaactccaaatgacgagcccttggatatgaaggaaggtgcaggattaactatacgtaaagtaaatcctgtagaagtgacaattacggctcgcctggcacctgagctttattaaaaccttagatgttttatcttgattgtactaatatatatatgcagaaaaaattg

SEQ ID NO: 184 - protein, 517 aa, Nicotiana tabacum
MVSPVEAIVGLVTLTLLFYFLWPKKFQIPSKPLPPKIPGGWPVIGHLFYFDDDGDDRPLARKLGDLADKYGPVFTFRLGLPLVLIVSSYEAVKDCFSTNDAIFSNRPAFLYGEYLGYNNAMLFLTKYGPYWRKNRKLVIQEVLSASRLEKLKHVRFGKIQTSIKSLYTRIDGNSSTINLTDWLEELNFGLIVKMIAGKNYESGKGDEQVERFRKAYKDFIILSMEFVLWDAFPIPLFKWVDFQGYVKAMKRTFKDIDSVFQNWLEEHVKKREKMEVNAQGNEQDFIDVVLSKMSNEYLDEGYSRDTVIKATVFSLVLDAADTVALHMNWGMALLINNQHALKKAQEEIDKKVGKERWVEESDIKDLVYLQAIVKEVLRLYPPGPLLVPHENVEDCVVSGYHIPKGTRLFANVMKLQRDPKLWSNPDKFDPERFFADDIDYRGQHYEFIPFGSGRRSCPGMTYALQVEHLTIAHLIQGFNYKTPNDEPLDMKEGAGLTIRKVNPVEVTITARLAPELY

SEQ ID NO: 185 - DNA, 1623 bp, Nicotiana tabacum
cgaggctccccaccaaaaaatcatttctctcgtctaaaatggatcttctcttactagagaagaccttaattggtcttttctttgccattttaatcgctttaattgtctctaaacttcgttcaaagcgttttaagcttcctccaggaccaattccagtaccagtttttggtaattggcttcaagttggtgatgatttaaaccacagaaatcttactgattatgccaaaaaatttggcgatcttttcttgttaagaatgggtcaacgtaacttagttgttgtgtcatctcctgaattagctaaagaagttttacacacacaaggtgttgaatttggttcaagaacaagaaatgttgtgtttgatatttttactggaaaaggtcaagatatggtttttactgtatatggtgaacattggagaaaaatgaggagaattatgactgtaccattttttactaataaagttgtgcaacagtatagaggggggtgggagtttgaggtggcaagtgtaattgaggatgtgaaaaaaaatcctgaatctgctactaatgggatcgtattaaggaggagattacaattaatgatgtataataatatgtttaggattatgtttgataggagatttgagagtgaagatgatcctttgtttgttaagcttaaggctttgaatggtgaaaggagtagattggctcaaagttttgagtataattatggtgattttattccaattttgaggccttttttgagaggttatttgaagatctgtaaagaagttaaggagaagaggctgcagcttttcaaagattactttgttgatgaaagaaagaagctttcaaataccaagagctcggacagcaatgccctaaaatgtgcgattgatcacattcttgaggctcaacagaagggagagatcaatgaggacaacgttctttacattgttgaaaacatcaatgttgctgcaattgaaacaacattatggtcaattgagtggggtatcgccgagctagtcaaccaccctcacatccaaaagaaactgcgcgacgagattgacacagttcttggaccaggagtgcaagtgactgaaccagacacccacaagcttccataccttcaggctgtgatcaaggaggcacttcgtctccgtatggcaattcctctattagtcccacacatgaaccttcacgacgcaaagcttggcgggtttgatattccagcagagagcaaaatcttggttaacgcttggtggttagctaacaacccggctcattggaagaaacccgaagagttcagacccgagaggttctttgaagaggagaagcatgttgaggccaatggcaatgacttcagatatcttccgtttggcgttggtaggaggagctgccctggaattatacttgcattgccaattcttggcatcactttgggacgtttggttcagaactttgagctgttgcctcctccaggccagtcgaagctcgacaccacagagaaaggtggacagttcagtctccacattttgaagcattccaccattgtgttgaaaccaaggtctttctgaactttgtgatcttattaattaaggggttctgaagaaatttgatagtgttggatattaagggcgaatt

SEQ ID NO: 186 - protein, 505 aa, Nicotiana tabacum
MDLLLLEKTLIGLFFAILIALIVSKLRSKRFKLPPGPIPVPVFGNWLQVGDDLNHRNLTDYAKKFGDLFLLRMGQRNLVVVSSPELAKEVLHTQGVEFGSRTRNVVFDIFTGKGQDMVFTVYGEHWRKMRRIMTVPFFTNKVVQQYRGGWEFEVASVIEDVKKNPESATNGIVLRRRLQLMMYNNMFRIMFDRRFESEDDPLFVKLKALNGERSRLAQSFEYNYGDFIPILRPFLRGYLKICKEVKEKRLQLFKDYFVDERKKLSNTKSSDSNALKCAIDHILEAQQKGEINEDNVLYIVENINVAAIETTLWSIEWGIAELVNHPHIQKKLRDEIDTVLGPGVQVTEPDTHKLPYLQAVIKEALRLRMAIPLLVPHMNLHDAKLGGFDIPAESKILVNAWWLANNPAHWKKPEEFRPERFFEEEKHVEANGNDFRYLPFGVGRRSCPGIILALPILGITLGRLVQNFELLPPPGQSKLDTTEKGGQFSLHILKHSTIVLKPRSF

SEQ ID NO: 187 - DNA, 1667 bp, Nicotiana tabacum
caacacgcttactatctcctaaatctccactcaaaaacaaagaagagaaagatttaaaactaataattatgaaagagatggtgcaaaacaatatgagcacttctcttcttgaaactttacaagctacgcccatgatattctacttcatcgtccctctcttctgcttattccttctctccaaatctcgccgtaaacgtttgcctccaggtccaactggctggcctctcattggtaacatgatgatgatggaccagttaactcaccgtggccttgccaaactagcccaaaaatatggtggtgtttttcaccttaaaatgggttatgttcacaaaattgtagtctctggtccagacgaagctcgccaagtattacaggaacacgacatcatattttcgaaccgtccagcgaccgtagccataagttacctaacatatgacagggcagacatggcttttgctgactatggactcttctggcggcagatgagaaaactatgtgtaatgaaactcttcagccgcaaacgagctgagtcatgggactcagttcgagacgaagcggattccatggttagaattgtaacaaccaacacaggcacagctgttaacttaggtgaacttgttttcagtctcactcgtaatattatctacagagctgcttttggaacttgttctgaagatggacaaggcgagttcattgaaattatgcaagagttttcgaagctatttggcgctttcaatatagctgattttattccatggctagggtgggttggtaagcagagtctaaatattagacttgctaaggctagagcgtcgcttgatgggttcattgattcgattattgatgaccatattattagaaagaaagcttatgttaatggcaaaaatgatggaggtgatcgagaaactgatatggtggatgagcttttagctttttacagtgaggaagcaaaagtaactgagtccgaagatttgcagaatgctatcagacttactaaggatagtatcaaagctatcatcatggatgtaatgtttggagggacagaaacagtggcttctgcaatagaatgggccatggcagagcttatgaggagtcctgaagatcttaaaaaagtacaacaagggctggctaacgttgttggactcaacagaaaagttgaagaatctgactttgaaaaattaacatacttaagatgttgtctaaaagaaactctacgacttcaccctccaatccctctcctcctccatgagaccgccgaggaatccaccgtctccggctaccatattccggcaaagtcacatgttattataaattcatttgccattgggcgtgacaaaaattcatgggaagatcctgaaacttataaaccatctaggtttctcaaagaaggtgtaccagattttaaaggaggtaattttgagtttataccatttgggtcgggtcggcggtcttgccccggtatgcaacttgggctttatgcattggaaatggctgtggcccatcttcttcattgttttacttgggaattgccagatggtatgaaaccaagtgagcttaaaatggatgatatttttggactcactgctccaagagctaatcgactcgtggctgtgcctactccacgcttgttgtgtcccctttattaattgaagaaaaaaggtggggct

SEQ ID NO: 188 - protein, 525 aa, Nicotiana tabacum
MKEMVQNNMSTSLLETLQATPMIFYFIVPLFCLFLLSKSRRKRLPPGPTGWPLIGNMMMMDQLTHRGLAKLAQKYGGVFHLKMGYVHKIVVSGPDEARQVLQEHDIIFSNRPATVAISYLTYDRADMAFADYGLFWRQMRKLCVMKLFSRKRAESWDSVRDEADSMVRIVTTNTGTAVNLGELVFSLTRNIIYRAAFGTCSEDGQGEFIEIMQEFSKLFGAFNIADFIPWLGWVGKQSLNIRLAKARASLDGFIDSIIDDHIIRKKAYVNGKNDGGDRETDMVDELLAFYSEEAKVTESEDLQNAIRLTKDSIKAIIMDVMFGGTETVASAIEWAMAELMRSPEDLKKVQQGLANVVGLNRKVEESDFEKLTYLRCCLKETLRLHPPIPLLLHETAEESTVSGYHIPAKSHVIINSFAIGRDKNSWEDPETYKPSRFLKEGVPDFKGGNFEFIPFGSGRRSCPGMQLGLYALEMAVAHLLHCFTWELPDGMKPSELKMDDIFGLTAPRANRLVAVPTPRLLCPLY

SEQ ID NO: 189 - DNA, 1620 bp, Nicotiana tabacum
gggggataagaatatggagataccatattacagcttaaaacttacaattttttcatttgcaattatctttgtactaagatgggcatggaaaatcttgaattatgtgtggttaaaaccaaaagaattggagaaatgcatcagacagcagggtttcaaaggaaactcttacaaattcttgtttggggatatgaaagagataaagaaaatgggtgaagaagctatgtctaagccaatcaatttctctcatgacatgatttggcctagagtcatgcccttcatccacaaaaccatcaccaattatggtaagaattgttttgtgtggtttgggccaagaccagcagtcctgatcacagacccggaacttgtaaaggaggtgctaacgaagaatttcgtttatcagaagccacctggcactccactcacaaaattggcagcaactggaattgcaggctatgaaacagataaatgggctacacatagaaggcttctcaatcctgcttttcaccttgacaagttgaagcatatgctacctgcattccaatttactgcttgtgagatgttgagcaaattggagaaagttgtctcaccaaatggaacagagatagatgtgtggccatatctacaaactttaacaagtgatgccatttcaagaactgcttttggcagtagttatgaagaaggaagaaagctttttgaacttcaaaaggaacaactttcactaattctagaagtgtcccgcacaatatacatcccaggatggaggtttttgccaacaaaaaggaacaaaaggatgaagcaaatatttaatgaagtacgagcgctggtattgggaattattaagaaaagattgagtatgattgaaaatggagaagctcctgatgatttattgggtatattattggcatccaatttaaaagaaatccaacaacatggaaataacaagaaatttggtatgagtattgatgaggtgattgaagagtgtaaactcttctattttgcggggcaagagacaacttcatctttacttgtatggactatgattttgttgtgcaaacatcctagttggcaagataaagctagagaagaggttttgcaagtgtttggaagtagggaagttgactatgacaagttgaatcagctaaaaatagtaactatgatcttaaacgaggtcttaaggttgtatccagcaggatatgcgattaatcgaatggtaaccaaagaaacaaagttagggaatttatgtttaccagctggggtacaactcttgttaccaacaattttgttgcaacatgatactgaaatatggggagatgatgcaatggagttcaatccagagagatttagtgatggaatatccaaagcaacaaaaggaaaacttgtgttctttccatttagttggggtccaagaatatgtattgggcaaaattttgctatgttagaggccaagatggcaatggctatgattctgaaaaactatgcatttgaactctctccatcttatgctcatgctcctcatccactactacttcaacctcaatatggtgctcaattaattttgtacaagttgtagaaatggtcaatttggaacttgttatggaacttttatcatcgtaatcaacc

SEQ ID NO: 190 - protein, 518 aa, Nicotiana tabacum
MEIPYYSLKLTIFSFAIIFVLRWAWKILNYVWLKPKELEKCIRQQGFKGNSYKFLFGDMKEIKKMGEEAMSKPINFSHDMIWPRVMPFIHKTITNYGKNCFVWFGPRPAVLITDPELVKEVLTKNFVYQKPPGTPLTKLAATGIAGYETDKWATHRRLLNPAFHLDKLKHMLPAFQFTACEMLSKLEKVVSPNGTEIDVWPYLQTLTSDAISRTAFGSSYEEGRKLFELQKEQLSLILEVSRTIYIPGWRFLPTKRNKRMKQIFNEVRALVLGIIKKRLSMIENGEAPDDLLGILLASNLKEIQQHGNNKKFGMSIDEVIEECKLFYFAGQETTSSLLVWTMILLCKHPSWQDKAREEVLQVFGSREVDYDKLNQLKIVTMILNEVLRLYPAGYAINRMVTKETKLGNLCLPAGVQLLLPTILLQHDTEIWGDDAMEFNPERFSDGISKATKGKLVFFPFSWGPRICIGQNFAMLEAKMAMAMILKNYAFELSPSYAHAPHPLLLQPQYGAQLILYKL

SEQ ID NO: 191 - DNA, 1566 bp, Nicotiana tabacum
gtcctaactaaaaatggagattcagttttctaacttagttgcattcttgctctttctctccagcatctttcttctattcaaaaaatggaaaaccagaaaactaaatttgcctcctggtccatggaaattaccttttattggaagtttacaccatttggctgtggcaggtccacttcctcaccatggcctaaaaaatttagccaaacgctatggtcctcttatgcatttacaacttggacaaattcctacactcatcatatcatcacctcaaatggcaaaagaagtactaaaaactcacgacctcgcttttgccactagaccaaagcttgtcgtggccgacatcattcactacgacagcacggacatagcattttctccgtacggtgaatactggagacaaattcgtaaaatttgcatattggaactcttgagtgccaagatggtcaaattttttagctcgattcgccaagatgagctctcgaagatgctctcatctatacgaacgacacccaatcttacagtcaatcttactgacaaaattttttggtttacgagttcggtaacttgtagatcagctttagggaagatatgtggtgaccaagacaaattgatcatttttatgagggaaataatatcattggcaggtggatttagtattgctgattttttccctacatggaaaatgattcatgatattgatggttcgaaatctaaactggtgaaagcacatcgtaagattgatgaaattttgggaaatgttgttgatgagcacaaaaagaacagagcagatggcaagaagggtaatggtgaatttggtggtgaagatttgattgatgtattgttaagagttagagaaagtggagaagttcaaattcctatcacaaatgacaatatcaaatcaatattaatcgacatgttctctgcgggatctgaaacatcatcgacgactataatttgggcattagctgaaatgatgaagaaaccaagtgttttagcaaaggcacaagctgaagtaaggcaagctttgaaggagaaaaaaggttttcaacagattgatcttgatgagctaaaatatctcaagttagtaatcaaagaaaccttaagaatgcaccctccaattcctctattagttcctagagaatgtatggaggatacaaagattgatggttacaatatacctttcaaaacaagagtcatagttaatgcatgggcaatcggacgagatccagaaagttgggatgaccccgaaagctttatgccagagagatttgagaatagttctattgactttcttggaaatcatcatcagtttataccatttggtgcaggaagaaggatttgtccgggaatgctatttggtttagctaatgttggacaacctttagctcagttactttatcacttcgattggaaactccctaatggacaaagtcatgagaatttcgacatgactgagtcacctggaatttctgctacaagaaaggatgatcttgttttgattgccactccttatgattcttattaagcagtagcagaaataaaaagccggggcaaacagaaaaaagt

SEQ ID NO: 192 - protein, 503 aa, Nicotiana tabacum; identical to SEQ ID NO: 152

SEQ ID NO: 193 - DNA, 1652 bp, Nicotiana tabacum
caactaacaaacacattgagtcctctcccaaatcactgattcaccaccaaaagtaccaacaattcaatggaaggtacaaacttgactacatatgcagcagtatttcttgatactctgtttcttttgttcctttccaaacttcttcgccagaggaaactcaatttacctccaggcccaaaaccatggccgatcatcggaaacttaaaccttattggcaatcttcctcatcgctcaatccacgaactctccctcaagtacggacccgttatgcaactccaattcgggtctttccccgttgtagttggatcctccgtcgaaatggctaagattttcctcaaatccatggatattaactttgtaggcaggcctaaaacggctgccggaaaatacacaacgtacaattattccgatattacatggtctccttacggaccatattggcgccaggcacgtaggatgtgcctaacggaattattcagcacgaaacgtctcgattcatacgagtatattcgggctgaggagttgcattctcttctccataatttgaacaaaatatcagggaaaccaattgtgttgaaagattattcgacgacgttgagtttaaatgttattagcaggatggtactggggaaaaggtatttggacgaatccgagaactcgttcgtgaatcctgaggaatttaagaagatgttggacgaattgtttttgctaaatggtgtacttaatattggagattcaattccatggattgatttcatggatttgcaaggttatgttaagaggatgaaagtagtgagcaagaaattcgacaagtttttagagcatgttattgatgagcataacattaggagaaatggagtggagaattatgttgctaaggatatggtggatgttttgttgcagctcgctgatgatccgaagttggaagttaagctggagagacatggagtcaaagcattcactcaggatatgctggctggtggaaccgagagttcagcagtgacagtggagtgggcaatttcagagctgctaaagaagccggagattttcaaaaaggctacagaagaattggatcgagtaattgggcagaatagatgggtacaagaaaaggacattccaaatcttccttacatagaggcaatagtcaaagagactatgcgactgcaccccgtggcaccaatgttggtgccacgtgagtgtcgagaagatattaaggtagcaggctacgacgttcagaaaggaactagggttctcgtgagtgtatggactattggaagagaccctacattgtgggacgagcctgaggtgttcaagccggagagattccatgaaaggtccatagatgttaaaggacatgattatgagcttttgccatttggagcggggagaagaatgtgcccgggttatagcttggggctcaaggtgattcaagctagcttagctaatcttctacatggatttaactggtcattgcctgataatatgactcctgaggacctcaacatggatgagatttttgggctctctacacctaaaaaatttccacttgctactgtgattgagccaagactttcaccaaaactttactctgtttgattcagcagttctatggttccgtcaagatagactttgttacgtttgaacctgtgctc

SEQ ID NO: 194 - protein, 509 aa, Nicotiana tabacum
MEGTNLTTYAAVFLDTLFLLFLSKLLRQRKLNLPPGPKPWPIIGNLNLIGNLPHRSIHELSLKYGPVMQLQFGSFPVVVGSSVEMAKIFLKSMDINFVGRPKTAAGKYTTYNYSDITWSPYGPYWRQARRMCLTELFSTKRLDSYEYIRAEELHSLLHNLNKISGKPIVLKDYSTTLSLNVISRMVLGKRYLDESENSFVNPEEFKKMLDELFLLNGVLNIGDSIPWIDFMDLQGYVKRMKVVSKKFDKFLEHVIDEHNIRRNGVENYVAKDMVDVLLQLADDPKLEVKLERHGVKAFTQDMLAGGTESSAVTVEWAISELLKKPEIFKKATEELDRVIGQNRWVQEKDIPNLPYIEAIVKETMRLHPVAPMLVPRECREDIKVAGYDVQKGTRVLVSVWTIGRDPTLWDEPEVFKPERFHERSIDVKGHDYELLPFGAGRRMCPGYSLGLKVIQASLANLLHGFNWSLPDNMTPEDLNMDEIFGLSTPKKFPLATVIEPRLSPKLYSV

SEQ ID NO: 195 - DNA, 1657 bp, Nicotiana tabacum
cttcttccttcctaactaaaaatggagattcagttttctaacttagttgcattcttgctctttctctccagcatctttcttgtattcaaaaaatggaaaaccagaaaactaaatttgcctcctggtccatggaaattaccttttattggaagtttacaccatttggctgtggcaggtccacttcctcaccatggcctaaaaaatttagccaaacgctatggtcctcttatgcatttacaacttggacaaattcctacactcgtcatatcatcacctcaaatggcaaaagaagtactaaaaactcacgacctcgcttttgccactagaccaaagcttgtcgtggccgacatcattcactacgacagcacggacatagcattttcgccatacggtgaatactggagacaaattcgtaaaatttgcatattggaactcttgagtgccaagatggtcaagttttttagctcgattcgccaagatgagctctcgaagatggtttcatctatacgaacgacgcccaatcttccagtcaatcttaccgacaagattttttggtttacgagttcggtaatttgtagatcagctttagggaagatatgtggtgaccaagacaaattgatcatttttatgagggaaataatatcattggcaggtggatttagtattgctgattttttccctacatggaaaatgattcatgatattgatggttcaaaatctaaactggtgaaggcacatcgtaagattgatgaaattttggaaaatgtggtaaatgagcacaaacagaatcgagcagatggtaaaaagggtaatggtgaatttggtggagaagatctgattgatgttttgttaagagttagagaaagtggagaagttcaaattccaatcacagatgacaatatcaaatcaatattaatcgacatgttctctgccggatcggaaacatcatcgacaactataatttgggcattagctgaaatgatgaagaaaccaagtgttttagcaaaggcacaagctgaagtgaggcaagctttgaaggggaagaaaattagttttcaagagattgatattgataagctaaagtatttgaagttagtgatcaaagaaactttaagaatgcaccctccaattcctctgttagtccctagagaatgtatggaagatacaaagattgatggttacaatatacctttcaaaacaagagtcattgttaatgcatgggcaattggacgagatcctcaaagttgggatgatcctgaaagctttacgccagagagatttgagaataattctattgattttcttggaaatcatcatcaatttattccatttggtgcaggaagaaggatttgtcctggaatgctatttggtttagctaatgttggacaacctttagctcagttactttatcacttcgattggaaactccctaatggacaaagtcatgagaatttcgacatgactgagtcacctggaatttctgctacaagaaaggatgatcttgttttgattgccactccttatgattcttattaagcagtagcagaaataaaaagccggggcaaacagaaaaaagtattgctgcttctaggtattttctattggataaatttcaaaattcatccacaatatttagtgtttgctagagttggttagc

SEQ ID NO: 196 - protein, 504 aa, Nicotiana tabacum
MEIQFSNLVAFLLFLSSIFLVFKKWKTRKLNLPPGPWKLPFIGSLHHLAVAGPLPHHGLKNLAKRYGPLMHLQLGQIPTLVISSPQMAKEVLKTHDLAFATRPKLVVADIIHYDSTDIAFSPYGEYWRQIRKICILELLSAKMVKFFSSIRQDELSKMVSSIRTTPNLPVNLTDKIFWFTSSVICRSALGKICGDQDKLIIFMREIISLAGGFSIADFFPTWKMIHDIDGSKSKLVKAHRKIDEILENVVNEHKQNRADGKKGNGEFGGEDLIDVLLRVRESGEVQIPITDDNIKSILIDMFSAGSETSSTTIIWALAEMMKKPSVLAKAQAEVRQALKGKKISFQEIDIDKLKYLKLVIKETLRMHPPIPLLVPRECMEDTKIDGYNIPFKTRVIVNAWAIGRDPQSWDDPESFTPERFENNSIDFLGNHHQFIPFGAGRRICPGMLFGLANVGQPLAQLLYHFDWKLPNGQSHENFDMTESPGISATRKDDLVLIATPYDSY

SEQ ID NO: 197 - DNA, 1610 bp, Nicotiana tabacum
cttcttccttcctaactaaaaatggagattcagttttctaacttagttgcattcttgctctttctctccagcatctttcttgtattcaaaaaatggaaaaccagaaaactaaatttgcctcctggtccatggaaattaccttttattggaagtttacaccatttggctgtggcaggtccacttcctcaccatggcctaaaaaatttagccaaacgctatggtcctcttatgcatttacaacttggacaaattcctacactcgtcatatcatcacctcaaatggcaaaagaagtactaaaaactcacgacctcgcttttgccactagaccaaagcttgtcgtggccgacatcattcactacgacagcacggacatagcactttcgccatacggtgaatactggagacaaattcgtaaaatttgcatattggaactcttgagtgccaagatggtcaagttttttagctcgattcgccaagatgagctctcgaagatggtttcatctatacgaacgacgcccaatcttccagtcaatcttaccgacaagattttttggtttacgagttcggtaatttgtagatcagctttagggaagatatgtggtgaccaagacaaattgatcatttttatgagggaaataatatcattggcaggtggatttagtattgctgattttttccctacatggaaaatgattcatgatattgatggttcaaaatctaaactggtgaaggcacatcgtaagattgatgaaattttggaaaatgtggtaaatgagcacaaacagaatcgagcagatggtaaaaagggtaatggtgaatttggtggagaagatctgattgatgttttgttaagagttagagaaagtggagaagttcaaattccaatcacagatgacaatatcaaatcaatattaatcgacatgttctctgccggatcggaaacatcatcgacaactataatttgggcattagctgaaatgatgaagaaaccaagtgttttagcaaaggcacaagctgaagtgagccaagctttgaaggggaagaaaattagttttcaagagattgatattgataagctaaagtatttgaagttagtgatcaaagaaactttaagaatgcaccctccaattcctctgttagtccctagagaatgtatggaagatacaaagattgatggttacaatatacctttcaaaacaagagtcattgttaatgcatgggcaattggacgagatcctcaaagttgggatgatcctgaaagctttacgccagagagatttgagaataattctattgattttcttggaaatcatcatcaatttattccatttggtgcaggaagaaggatttgtcctggaatgctatttggtttagctaatgttggacaacctttagctcagttactttatcacttcgattggaaactccctaatggacaaactcaccaaaatttcgacatgactgagtcacctggaatttctgctacaagaaaggatgatcttattttgattgccactcctgctcattcttgattaagtattgctgcttttctattggagaattttcaaaattcatccacaatatatagtgtttgctagagttggttagc

SEQ ID NO: 198 - protein, 503 aa, Nicotiana tabacum
MEIQFSNLVAFLLFLSSIFLVFKKWKTRKLNLPPGPWKLPFIGSLHHLAVAGPLPHHGLKNLAKRYGPLMHLQLGQIPTLVISSPQMAKEVLKTHDLAFATRPKLVVADIIHYDSTDIALSPYGEYWRQIRKICILELLSAKMVKFFSSIRQDELSKMVSSIRTTPNLPVNLTDKIFWFTSSVICRSALGKICGDQDKLIIFMREIISLAGGFSIADFFPTWKMIHDIDGSKSKLVKAHRKIDEILENVVNEHKQNRADGKKGNGEFGGEDLIDVLLRVRESGEVQIPITDDNIKSILIDMFSAGSETSSTTIIWALAEMMKKPSVLAKAQAEVSQALKGKKISFQEIDIDKLKYLKLVIKETLRMHPPIPLLVPRECMEDTKIDGYNIPFKTRVIVNAWAIGRDPQSWDDPESFTPERFENNSIDFLGNHHQFIPFGAGRRICPGMLFGLANVGQPLAQLLYHFDWKLPNGQTHQNFDMTESPGISATRKDDLILIATPAHS

SEQ ID NO: 199 - DNA, 1664 bp, Nicotiana tabacum
atccttcttccttcctaggtcctaactaaaaatggagattcagttttctaacttagttgcattcttgctctttctctccagcatctttcttctattcaaaaaatggaaaaccagaaaactaaatttgcctcctggtccatggaaattaccttttattggaagtttacaccatttggctgtggcaggtccacttcctcaccatggcctaaaaaatttagccaaacgctatggtcctcttatgcatttacaacttggacaaattcctacactcatcatatcatcacctcaaatggcaaaagaagtactaaaaactcacgacctcgcttttgccactagaccaaagcttgtcgtggccgacatcattcactacgacagcacggacatagcattttctccgtacggtgaatactggagacaaattcgtaaaatttgcatattggaactcttgagtgccaagatggtcaaattttttagctcgattcgccaagatgagctctcgaagatgctctcatctatacgaacgacacccaatcttacagtcaatcttactgacaaaattttttggtttacgagttcggtaacttgtagatcagctttagggaagatatgtggtgaccaagacaaattgatcatttttatgagggaaataatatcattggcaggtggatttagtattgctgattttttccctacatggaaaatgattcatgatattgatggttcgaaatctaaactggtgaaagcacatcgtaagattgatgaaattttgggaaatgttgttgatgagcacaaaaagaacagagcagatggcaagaagggtaatggtgaatttggtggtgaagatttgattgatgtattgttaagagttagagaaagtggagaagttcaaattcctatcacaaatgacaatatcaaatcaatattaatcgacatgttctctgcgggatctgaaacatcatcgacgactataatttgggcattagctgaaatgatgaagaaaccaagtgttttagcaaaggcacaagctgaagtaaggcaagctttgaaggagaaaaaaggttttcaacagattgatcttgatgagctaaaatatctcaagttagtaatcaaagaaaccttaagaatgcaccctccaattcctctattagttcctagagaatgtatggaggatacaaagattgatggttacaatatacctttcaaaacaagagtcatagttaatgcatgggcaatcggacgagatccagaaagttgggatgaccccgaaagctttatgccagagagatttgagaatagttctattgactttcttggaaatcatcatcagtttataccatttggtgcaggaagaaggatttgtccgggaatgctatttggtttagctaatgttggacaacctttagctcagttactttatcacttcgattggaaactccctaatggacaaagtcatgagaatttcgacatgactgagtcacctggaatttctgctacaagaaaggatgatcttgttttgattgccactccttatgattcttattaagcagtagcagaaataaaaagccggggcaaacagaaaaaagtattgctgcttctaggtattttctattggataaatttcaaaattcatccacaatatttagtgtttgctagagttggttagc

SEQ ID NO: 200 - protein, 503 aa, Nicotiana tabacum; identical to SEQ ID NO: 152

SEQ ID NO: 201 - DNA, 1625 bp, Nicotiana tabacum
ttcttattttgattcaaccatggagaaccaatactcctactcattctcttcctacttctacttagctatagtactgtttcttcttccaattttggtcaaatatttcttccatcggagaagaaatttacctccaagtccattttctcttccaataattggtcacctttaccttctcaagaaaactctccatctcactctaacatccttatcagctaaatatggtcctgttttatacctcaaattgggctctatgcctgtgattgttgtgtcctcaccatctgctgttgaagaatgtttaaccaagaatgatatcatattcgcaaataggcccaagaccgtggctggtgacaagtttacctacaattatactgtttatgtttgggcaccctatggccaactttggagaattcttcgccgattaactgtcgttgaactcttctcttcacatagcctacagaaaacttctatccttagagatcaagaagttgcaatatttatccgttcgttatacaaattctcaaaggatagtagcaaaaaagtcgatttgaccaactggtcttttactttggttttcaatcttatgaccaaaattattgctgggagacatattgtgaaggaggaagatgctggcaaggaaaagggcattgaaattattgaaaaacttagagggactttcttagtaactacatcattcttgaatatgtgtgatttcttgccagtattcaggtgggttggttacaaagggctggagaagaagatggcctcaattcacaatagaagaaatgaattcttgaacagcttgcttgatgaatttcgacacaagaaaagtagtgcttcacaatctaacacaactgttggaaacatggagaagaaaaccacactgattgaaaagctcttgtctcttcaagaatcagagcctgaattctacactgatgatatcatcaaaagtattatgctggtagtttttgttgcaggaacagagacctcatcaacaaccatccaatgggtaatgaggcttcttgtagctcaccctgaggcattgtataagctacgagctgacattgacagtaaagttgggaataagcgcttgctgaatgaatcagacctcaacaagcttccgtatttgcattgtgttgttaatgagacaatgagattatacactccgataccacttttattgcctcattattcaactaaagattgtattgtggaaggatatgatgtaccaaaacatacaatgttgtttgtcaacgcttgggccattcacagggatcccaaggtatgggaggagcctgacaagttcaagccagagagatttgaggcaacagaaggggaaacagaaaggttcaattacaagcttgtaccatttggaatggggagaagagcgtgccctggagctgatatggggttgcgagcagtttctttggcattaggtgcacttattcaatgctttgactggcaaattgaggaagcggaaagcttggaggaaagctataattctagaatgactatgcagaacaagcctttgaaggttgtctgcactccacgcgaagatcttggccagcttctatcccaactctaaggcaatttatcaatgccaaacgtaatcttcatctaccactatg

SEQ ID NO: 202 - protein, 520 aa, Nicotiana tabacum
MENQYSYSFSSYFYLAIVLFLLPILVKYFFHRRRNLPPSPFSLPIIGHLYLLKKTLHLTLTSLSAKYGPVLYLKLGSMPVIVVSSPSAVEECLTKNDIIFANRPKTVAGDKFTYNYTVYVWAPYGQLWRILRRLTVVELFSSHSLQKTSILRDQEVAIFIRSLYKFSKDSSKKVDLTNWSFTLVFNLMTKIIAGRHIVKEEDAGKEKGIEIIEKLRGTFLVTTSFLNMCDFLPVFRWVGYKGLEKKMASIHNRRNEFLNSLLDEFRHKKSSASQSNTTVGNMEKKTTLIEKLLSLQESEPEFYTDDIIKSIMLVVFVAGTETSSTTIQWVMRLLVAHPEALYKLRADIDSKVGNKRLLNESDLNKLPYLHCVVNETMRLYTPIPLLLPHYSTKDCIVEGYDVPKHTMLFVNAWAIHRDPKVWEEPDKFKPERFEATEGETERFNYKLVPFGMGRRACPGADMGLRAVSLALGALIQCFDWQIEEAESLEESYNSRMTMQNKPLKVVCTPREDLGQLLSQL

SEQ ID NO: 203 - DNA, 1767 bp, Nicotiana tabacum
aaccaaccttccttttcttacttagtaaaatggatattcagtcttctcctttcaacttaattgctttgctactcttcatttcatttctttttatcctattgaaaaagtggaataccaaaatcccaaagttacctccaggtccatggagacttccccttattggcagcctccatcacttgaaaggtaaactcccacaccatcatcttagagatttagcccgaaaatatggacctctcatgtatttacaacttggagaagttcctgtagttgtaatatcttcgccacgtatagcaaaagctgtactaaaaactcatgatcttgcttttgcaacgaggcctcggttcatgtcctcggacattgtgttttacaaaagcagggacatatcattcgccccatatggcgattactggagacaaatgcgtaaaatattaacacaagaactcttgagtaacaagatgctcaagtcatttagcacaatccgaaaggatgagctctcgaagctcctctcgtcgattcgtttagcaacagcttcttctgcagtgaacataaacgaaaagcttctctggtttacaagttgcatgacttgtagattagcctttggaaaaatatgcaacgatcgtgatgaattgattatgttaataagggagatattagcattatcaggaggatttgatgtgtgtgatttgttcccttcatggaaattacttcacaatatgagcaacatgaaagctagattgacgaatgttcaccataagtataatctaattatggagaatatcatcaatgagcacaaagagaatcatgcagcagggataaagggaaataacgagtttggtggcgaagatatgattgatgctttactgagggttaaggagaataatgagcttcaatttcctatcgaaaatgacaacatgaaagcagtaattctggacttgtttattgctggaactgaaacttcatatactgcaattatatgggcactatcagaattgatgaagcacccaagtgttatggccaaggcacaagctgaagtgagaaaagtcttcaaagaaaatgaaaacttggacgaaaatgatcttgacaagttgccatacttaaaatcagtgatcaaagaaacactaaggatgcatcctccagttcctttattaggacctagagaatgcagagaacaaactgagattgatggatatactgtacctcttaaagctagagtaatggttaatgcatgggcaattggaagagatcctgaaagttgggaagatcctgaaagtttcaaacccgagcgatttgaaaatatttctgttgatcttacgggaaatcactatcagttcatccctttcggttcaggaagaagaatgtgtccaggaatgtcgtttggtttagttaacactgggcatcctttagctcagttgctctatttctttgactggaaattccctcataaggttaatgcagctgattttcacactactgaaacaagtagagtttttgcagcaagcaaagatgacctctacttgattccaacaaatcacatggagcaagagtagctctaaattgaattcttgtcttggaacaataaaagaagaaactccagcttggtctacattatttctttttgctttatattagtatgggtgtgttcagtttcttatttttaagggtaccctgaaagataaagggctatataaaccagtgagactttttattggttgcaaggttttagatcaagccataagacagcatattttattcaaaaaaaaaaaaaaa

SEQ ID NO: 204 - protein, 505 aa, Nicotiana tabacum
MDIQSSPFNLIALLLFISFLFILLKKWNTKIPKLPPGPWRLPLIGSLHHLKGKLPHHHLRDLARKYGPLMYLQLGEVPVVVISSPRIAKAVLKTHDLAFATRPRFMSSDIVFYKSRDISFAPYGDYWRQMRKILTQELLSNKMLKSFSTIRKDELSKLLSSIRLATASSAVNINEKLLWFTSCMTCRLAFGKICNDRDELIMLIREILALSGGFDVCDLFPSWKLLHNMSNMKARLTNVHHKYNLIMENIINEHKENHAAGIKGNNEFGGEDMIDALLRVKENNELQFPIENDNMKAVILDLFIAGTETSYTAIIWALSELMKHPSVMAKAQAEVRKVFKENENLDENDLDKLPYLKSVIKETLRMHPPVPLLGPRECREQTEIDGYTVPLKARVMVNAWAIGRDPESWEDPESFKPERFENISVDLTGNHYQFIPFGSGRRMCPGMSFGLVNTGHPLAQLLYFFDWKFPHKVNAADFHTTETSRVFAASKDDLYLIPTNHMEQE

SEQ ID NO: 205 - DNA, 1736 bp, Nicotiana tabacum
aaccaaccttccttttcttacttagtaaaatggatattcagtcttctcctttcaacttaattgctttgctactcttcatttcatttctttttatcctattgaaaaagtggaataccaaaatcccaaagttacctccaggtccatggagacttccccttattggcagcctccatcacttgaaaggtaaactcccacaccatcatcttagagatttagcccgaaaatatggacctctcatgtatttacaacttggagaagttcctgtagttgtaatatcttcgccacgtatagcaaaagctgtactaaaaactcatgatcttgcttttgcaacgaggcctcggttcatgtcctcggacattgtgttttacaaaagcagggacatatcattcgccccatatggcgattactggagacaaatgcgtaaaatattaacacaagaactcttgagtaacaagatgctcaagtcatttagcacaatccgaaaggatgggctctcgaagctcctctcgtcgattcgtttagcaacagcttcttctgcagtgaacataaacgaaaagcttctctggtttacaagttgcatgacttgtagattagcctttggaaaaatatgcaacgatcgtgatgaattgattatgttaataagggagatattagcattatcaggaggatttgatgtgtgtgatttgttcccttcatggaaattacttcacaatatgagcaacatgaaagctagattgacgaatgttcaccataagtataatctaattatggagaatatcatcaatgagcacaaagagaatcatgcagcagggataaagggaaataacgagtttggtggcgaagatatgattgatgctttactgagggttaaggagaataatgagcttcaatttcctatcgaaaatgacaacatgaaagcagtaattctggacttgtttattgctggaactgaaacttcatatactgcaattatatgggcactatcagaattgatgaagcacccaagtgttatggccaaggcacaagctgaagtgagaaaagtcttcaaagaaaatgaaaacttggacgaaaatgatcttgacaagttgccatacttaaaatcagtgatcaaagaaacactaaggatgcatcctccagttcctttattaggacctagagaatgcagagaacaaactgagattgatggatatactgtacctcttaaagctagagtaatggttaatgcatgggcaattggaagagatcctgaaagttgggaagatcctgaaagtttcaaacccgagcgatttgaaaatatttctgttgatcttacgggaaatcactatcagttcattcctttcggttcaggaagaagaatgtgtccaggaatgtcgtttggtttagttaacactgggcatcctttagctcagttgctctatttctttgactggaaattccctcataaggttaatgcagctgattttcacactactgaaacaagtagagtttttgcagcaagcaaagatgacctctacttgattccaacaaatcacatggagcaagagtagctctaaattgaattcttgtcttggaacgataaaagaagaaactccagcttggtctacattatttctttttgctttatattagtatgggtgtgttcagtttcttgtttttaagggtaccctgaaagataaagggctatataaaccagtgagactttttattgaaaaaaaaaaaaaaaaaaaaaaaaaaaa

SEQ ID NO: 206 - protein, 505 aa, Nicotiana tabacum
MDIQSSPFNLIALLLFISFLFILLKKWNTKIPKLPPGPWRLPLIGSLHHLKGKLPHHHLRDLARKYGPLMYLQLGEVPVVVISSPRIAKAVLKTHDLAFATRPRFMSSDIVFYKSRDISFAPYGDYWRQMRKILTQELLSNKMLKSFSTIRKDELSKLLSSIRLATASSAVNINEKLLWFTSCMTCRLAFGKICNDRDELIMLIREILALSGGFDVCDLFPSWKLLHNMSNMKARLTNVHHKYNLIMENIINEHKENHAAGIKGNNEFGGEDMIDALLRVKENNELQFPIENDNMKAVILDLFIAGTETSYTAIIWALSELMKHPSVMAKAQAEVRKVFKENENLDENDLDKLPYLKSVIKETLRMHPPVPLLGPRECREQTEIDGYTVPLKARVMVNAWAIGRDPESWEDPESFKPERFENISVDLTGNHYQFIPFGSGRRMCPGMSFGLVNTGHPLAQLLYLFDWKFPHKVNAADFHTTETSRVFAASKDDLYLIPTNHMEQE

SEQ ID NO: 207 - DNA, 1823 bp, Nicotiana tabacum
aaccaaccttccttttcttacttagtaaaatggatattcagtcttctcctttcaacttaattgctttgctactcttcatttcatttctttttatcctattgaaaaagtggaataccaaaatcccaaagttacctccaggtccatggagacttccccttattggcagcctccatcacttgaaaggtaaactcccacaccatcatcttagagatttagcccgaaaatatggacctctcatgtatttacaacttggagaagttcctgtagttgtaatatcttcgccacgtatagcaaaagctgtactaaaaactcatgatcttgcttttgcaacgaggcctcggttcatgtcctcggacattgtgttttacaaaagcagggacatatcattcgccccatatggcgattactggagacaaatgcgtaaaatattaacacaagaactcttgagtaacaagatgctcaagtcatttagcacaatccgaaaggatgagctctcgaagctcctctcgtcgattcgtttagcaacagcttcttctgcagtgaacataaacgaaaagcttctctggtttacaagttgcatgacttgtagattagcctttggaaaaatatgcaacgatcgtgatgaattgattatgttaataagggagatattagcattatcaggaggatttgatgtgtgtgatttgttcccttcatggaaattacttcacaatatgagcaacatgaaagctagattgacgaatgttcaccataagtataatctaattatggagaatatcatcaatgagcacaaagagaatcatgcagcagggataaagggaaataacgagtttggtggcgaagatatgattgatgctttactgagggttaaggagaataatgagcttcaatttcctatcgaaaatgacaacatgaaagcagtaattctggacttgtttattgctggaactgaaacttcatatactgcaattatatgggcactatcagaattgatgaagcacccaagtgttatggccaaggcacaagctgaagtgagaaaagtcttcaaagaaaatgaaaacttggacgaaaatgatcttgacaagttgccatacttaaaatcagtgatcaaagaaacactaaggatgcatcctccagttcctttattaggacctagagaatgcagagaacaaactgagattgatggatatactgtacctcttaaagctagagtaatggttaatgcatgggcaattggaagagatcctgaaagttgggaagatcctgaaagtttcaaacccgagcgatttgaaaatatttctgttgatcttacgggaaatcactatcagttcattcctttcggttcaggaagaagaatgtgtccaggaatgtcgtttggtttagttaacactgggcatcctttagctcagttgctctatctctttgactggaaattccctcataaggttaatgcagctgattttcacactactgaaacaagtagagtttttgcagcaagcaaagatgacctctacttgattccaacaaatcacatggagcaagagtagctctaaattgaattcttgtcttggaacaataaaagaagaaactccagcttggtctacattatttccttttgctttatattagtatgggtgtgttcagtctcttgtttttaagggtaccctgaaagataaagggctatataaaccagtgagactttttattggttgcaaggttttagatcaagccataagacagcatattttattccaccattttctatcatgtttaataaagttcctttcgtttattgttagaaaaaaaaaaaaaaaaaaaaaaaa

SEQ ID NO: 208 - protein, 505 aa, Nicotiana tabacum; identical to SEQ ID NO: 206

SEQ ID NO: 209 - DNA, 1673 bp, Nicotiana tabacum
atatgcaactgagatttgaagaataccaactaaccaaaatgcagttcttcagcctggtttccattttcctatttctatctttcctctttttgttaagggtatggaagaactccaatagccaaagcaaaaagttgccaccaggtccatggaaactaccaatactaggaagtatgcttcatatggttggtggactaccacaccatgtccttagagatttagccaaaaaatatggaccacttatgcaccttcaattaggtgaagtttctgcggttgtggttacttctcctgatacggcaaaagaagtattaaaaactcatgacatcgcttttgcgtctaggcctagccttttggccccggagattgtctgttacaataggtctgatctagccttttgcccctatggcgactattggagacaaatgcgtaaaatatgtgtcttggaagtgctcagtgccaagaatgttcggacatttagctctattaggcggaatgaagttcttcgtctcattaattttatccggtcatcttctggtgaacctattaatgttacggaaaggatctttttgttcacaagctccatgacatgtagatcagcgtttgggcaagtgttcaaagagcaagacaaatttatacaactaattaaagaagtgatactcttagcaggagggtttgatgtggctgacatattcccttcactgaagtttcttcatgtgctcagtggaatgaagggtaagattatgaatgcacaccataaggtagatgccattgttgagaatgtcatcaatgagcacaagaaaaatcttgcaattgggaaaactaatggagcgttaggaggtgaagatttaattgatgttcttctaagacttatgaatgatggaggccttcaatttcctatcaccaacgacaacatcaaagctataatttttgacatgtttgctgccgggacagagacttcatcgtcaacaattgtgtgggctatggtagaaatggtgaaaaatccagccgtattcgcgaaagctcaagcagaagtaagagaagcatttagaggaaaagaaactttcgatgaaaatgatgtggaggagctaaactacctaaagttagtaataaaagaaactctaagacttcatccaccggttccacttttgctcccaagagaatgtagggaagagacaaatataaacggctacactattcctgtaaagaccaaagtcatggttaatgtttgggctttgggaagagatccaaaatattggaatgacgcagaaacttttatgccagagagatttgagcagtgctctaaggattttgttggtaataattttgaatatcttccatttggtggcggaaggaggatttgtcctgggatttcgtttggcttagctaatgcttatttgccattggctcaattactatatcacttcgattggaaactccctgctggaatcgaaccaagcgacttggacttgactgagttggttggagtaactgccgctagaaaaagtgacctttacttggttgcgactccttatcaacctcctcaaaagtgatttaatggtttcaagtttttatttcctagcaaaccccactattgtcctatctttcttttggtgttttcggttttatctactctaatacatgcatcttttaccatataggaatgtaccatgttgtcg

SEQ ID NO: 210 - protein, 514 aa, Nicotiana tabacum
MQLRFEEYQLTKMQFFSLVSIFLFLSFLFLLRVWKNSNSQSKKLPPGPWKLPILGSMLHMVGGLPHHVLRDLAKKYGPLMHLQLGEVSAVVVTSPDTAKEVLKTHDIAFASRPSLLAPEIVCYNRSDLAFCPYGDYWRQMRKICVLEVLSAKNVRTFSSIRRNEVLRLINFIRSSSGEPINVTERIFLFTSSMTCRSAFGQVFKEQDKFIQLIKEVILLAGGFDVADIFPSLKFLHVLSGMKGKIMNAHHKVDAIVENVINEHKKNLAIGKTNGALGGEDLIDVLLRLMNDGGLQFPITNDNIKAIIFDMFAAGTETSSSTIVWAMVEMVKNPAVFAKAQAEVREAFRGKETFDENDVEELNYLKLVIKETLRLHPPVPLLLPRECREETNINGYTIPVKTKVMVNVWALGRDPKYWNDAETFMPERFEQCSKDFVGNNFEYLPFGGGRRICPGISFGLANAYLPLAQLLYHFDWKLPAGIEPSDLDLTELVGVTAARKSDLYLVATPYQPPQK

SEQ ID NO: 211 - DNA, 1673 bp, Nicotiana tabacum
atatgcaactgagatttgaagaataccaactaaccaaaatgcagttcttcagcttggtttccattttcctatttctatctttcctctttttgttaaggatatggaagaactccaatagccaaagcaaaaagttgccaccaggtccatggaaactaccaatactaggaagtatgcttcatatggttggtggactaccacaccatgtccttagagatttagccaaaaaatatggaccacttatgcaccttcaattaggtgaagtttctgcggttgtggttacttctcctgatacggcaaaagaagtattaaaaactcatgacatcgcttttgcgtctaggcctagccttttggccccggagattgtctgttacaataggtctgatctagccttttgcccctatggcgactattggagacaaatgcgtaaaatatgtgtcttggaagtgctcagtgccaagaatgttcggacatttagctctattaggcggaatgaagttcttcgtctcattaattttatccggtcatcttctggtgaacctattaatgttacggaaaggatctttttgttcacaagctccatgacatgtagatcagcgtttgggcaagtgttcaaagagcaagacaaatttatacaactaattaaagaagtgatactcttagcaggagggtttgatgtggctgacatattcccttcactgaagtttcttcatgtgctcagtggaatgaagggtaagattatgaatgcacaccataaggtagatgccattgttgagaatgtcatcaatgagcacaagaaaaatcttgcaattgggaaaactaatggagcgttaggaggtgaagatttaattgatgttcttctaagacttatgaatgatggaggccttcaatttcctatcaccaacgacaacatcaaagccataatttttgacatgtttgctgccgggacagagacttcatcgtcaacaattgtgtgggctatggtagaaatggtgaaaaatccagccgtattcgcgaaagctcaagcagaagtaagagaagcatttagaggaaaagaaactttcgatgaaaatgatgtggaggagctaaactacctaaagttagtaataaaagaaactctaagacttcatccaccggttccacttttgctcccaagagaatgtagggaagagacaaatataaacggctacactattcctgtaaagaccaaagtcatggttaatgtttgggctttgggaagagatccaaaatattggaatgacgcagaaacttttatgccagagagatttgagcagtgctctaaggattttgttggtaataattttgaatatcttccatttggtggcggaaggaggatttgtcctgggatttcgtttggcttagctaatgcttatttgccattggctcaattactatatcacttcgattggaaactccctgctggaatcgaaccaagcgacttggacttgactgagttggttggagtaactgccgctagaaaaagtgacctttacttggttgcgactccttatcaacctcctcaaaagtgatttaatggtttcaagtttttatttcctagcaaaccccactattgtcctatctttcttttggtgttttcggttttatctactctaatacatgcatcttttaccatataggaatgtaccatgttgtcg

SEQ ID NO: 212 - protein, 514 aa, Nicotiana tabacum
MQLRFEEYQLTKMQFFSLVSIFLFLSFLFLLRIWKNSNSQSKKLPPGPWKLPILGSMLHMVGGLPHHVLRDLAKKYGPLMHLQLGEVSAVVVTSPDTAKEVLKTHDIAFASRPSLLAPEIVCYNRSDLAFCPYGDYWRQMRKICVLEVLSAKNVRTFSSIRRNEVLRLINFIRSSSGEPINVTERIFLFTSSMTCRSAFGQVFKEQDKFIQLIKEVILLAGGFDVADIFPSLKFLHVLSGMKGKIMNAHHKVDAIVENVINEHKKNLAIGKTNGALGGEDLIDVLLRLMNDGGLQFPITNDNIKAIIFDMFAAGTETSSSTIVWAMVEMVKNPAVFAKAQAEVREAFRGKETFDENDVEELNYLKLVIKETLRLHPPVPLLLPRECREETNINGYTIPVKTKVMVNVWALGRDPKYWNDAETFMPERFEQCSKDFVGNNFEYLPFGGGRRICPGISFGLANAYLPLAQLLYHFDWKLPAGIEPSDLDLTELVGVTAARKSDLYLVATPYQPPQK

SEQ ID NO: 213 - DNA, 1673 bp, Nicotiana tabacum
atatgcaactgagatttgaagaataccaactaaccaaagtgcagttcttcagcttggtttccattttcctatttctatctttcctctttttgttaaggatatggaagaactccaatagccaaagcaaaaagttgccaccaggtccatggaaactaccaatactaggaagtatgcttcatatggttggtggactaccacaccatgtccttagagatttagccaaaaaatatggaccacttatgcaccttcaattaggtgaagtttctgcggttgtggttacttctcctgatacggcaaaagaagtattaaaaactcatgacatcgcttttgcgtctaggcctagccttttggccccggagattgtctgttacaataggtctgatctagccttttgcccctatggcgactattggagacaaatgcgtaaaatatgtgtcttggaagtgctcagtgccaagaatgttcggacatttagctctattaggcggaatgaagttcttcgtctcattaattttatccggtcatcttctggtgaacctattaatgttacggaaaggatctttttgttcacaagctccatgacatgtagatcagcgtttgggcaagtgttcaaagagcaagacaaatttatacaactaattaaagaagtgatactcttagcaggagggtttgatgtggctgacatattcccttcactgaagtttcttcatgtgctcagtggaatgaagggtaagattatgaatgcacaccataaggtagatgccattgttgagaatgtcatcaatgagcacaagaaaaatcttgcaattgggaaaactaatggagcgttaggaggtgaagatttaattgatgttcctctaagacttatgaatgatggaggccttcaatttcctatcaccaacgacaacatcaaagctataatttttgacatgtttgctgccgggacggagacttcatcgtcaacaattgtgtgggctatggtagaaatggtgaaaaatccagccgtattcgcgaaagctcaagcagaagtaagagaagcatttagaggaaaagaaactttcgatgaaaatgatgtggaggagctaaactacctaaagttagtaataaaagaaactctaagacttcatccaccggttccacttttgctcccaagagaatgtagggaagagacaaatataaacggctacactattcctgtaaagaccaaagtcatggttaatgtttgggctttgggaagagatccaaaatattggaatgacgcagaaacttttatgccagagagatttgagcagtgctctaaggattttgttggtaataattttgaatatcttccatttggtggcggaaggaggatttgtcctgggatttcgtttggcttagctaatgcttatttgccattggctcaattactatatcacttcgattggaaactccctgctggaatcgaaccaagcgacttggacttgactgagttggttggagtaactgccgctagaaaaagtgacctttacttggttgcgactccttatcaacctcctcaaaagtgatttaatggtttcaagtttttatttcctagcaaaccccactattgtcctatctttcttttggtgttttcggttttatctactctaatacatgcatcttttaccatataggaatgtaccatgttgtcg

SEQ ID NO: 214 - protein, 514 aa, Nicotiana tabacum
MQLRFEEYQLTKVQFFSLVSIFLFLSFLFLLRIWKNSNSQSKKLPPGPWKLPILGSMLHMVGGLPHHVLRDLAKKYGPLMHLQLGEVSAVVVTSPDTAKEVLKTHDIAFASRPSLLAPEIVCYNRSDLAFCPYGDYWRQMRKICVLEVLSAKNVRTFSSIRRNEVLRLINFIRSSSGEPINVTERIFLFTSSMTCRSAFGQVFKEQDKFIQLIKEVILLAGGFDVADIFPSLKFLHVLSGMKGKIMNAHHKVDAIVENVINEHKKNLAIGKTNGALGGEDLIDVPLRLMNDGGLQFPITNDNIKAIIFDMFAAGTETSSSTIVWAMVEMVKNPAVFAKAQAEVREAFRGKETFDENDVEELNYLKLVIKETLRLHPPVPLLLPRECREETNINGYTIPVKTKVMVNVWALGRDPKYWNDAETFMPERFEQCSKDFVGNNFEYLPFGGGRRICPGISFGLANAYLPLAQLLYHFDWKLPAGIEPSDLDLTELVGVTAARKSDLYLVATPYQPPQK

SEQ ID NO: 215 - DNA, 1580 bp, Nicotiana tabacum
gaaatgggaaatgctcacaacagcaaaattgcagcaatctgtttgataattttcttggtatataaagcatgggaattgttgaagtggatatggattaagccaaagaaactggagagttgcctcagaaaacagggactcaaaggaaattcctacaggctattctatggagatatgaaagaattgtccaaaagtctcaaggaaatcaattcaaagcccatcatcaatctatcaaatgaagtagccccaagaatcattccttattatcttgaaatcatccaaaaatatggtaaaagatgttttgtttggcaaggaccaacccccgcaatattaataacagagccagaattaataaaggagatatttggtaagaactatgtttttcagaagcctaataatcccaacccactgaccaagttattggctcgaggtgttgtaagctacgaggaagaaaaatgggcaaaacacagaaagatcttaaaccctgcctttcatatggagaagttgaagcatatgctaccagcattttacttgagctgtagtgagatgctgaacaaatgggaggagattatcccagtaaaagaatcaaatgagttggacatttggcctcatcttcaaagaatgacaagtgatgtgatttctcgtgctgcctttggtagtagctacgaagaaggaagaagaatatttgaacttcaagaagaacaagctgagtatctaacgaagacattcaattcagtttatatcccaggttccagattttttcccaataaaatgaacaaaagaatgaaagaatgtgaaaaggaagtacgagaaacaattacgtgtctaattgacaacagattaaaggcaaaagaagaaggcaatggcaaggccctcaatgatgacctactgggtatattattagagtcaaattctatagaaattgaagaacatggtaacaagaagtttggaatgagtatacctgaagtaattgaagagtgcaaattattctattttgctggccaagagactacatcagtattgcttgtgtggacactgattttgttagggagaaatccagaatggcaggaacgtgctagagaggaagtttttcaagcctttggaagtgataaaccaacttttgacgaattatatcgcttgaaaattgtgacgatgattttgtacgagtctttaaggttatatccaccaatagcaactcgtactcgaaggactaatgaagaaacaaaattaggggaactagatttaccaaagggtgcactgctctttataccaacaatcttattacatcttgacaaggaaatttggggtgaagatgcagatgagttcaatccggagagatttagcgaaggggtggcaaaggcaacaaaggggaaaatgacatattttccatttggtgcaggaccgcgaaaatgcattgggcaaaacttcgcgattttggaagcaaaaatggctatagctatgattctacaacgcttctccttcgagctctctccatcttatacacactctccatacactgtggtcactttgaaacccaaatatggtgctcccctaataatgcacaggctgtagtcctgtgagaa

SEQ ID NO: 216 - protein, 521 aa, Nicotiana tabacum
MGNAHNSKIAAICLIIFLVYKAWELLKWIWIKPKKLESCLRKQGLKGNSYRLFYGDMKELSKSLKEINSKPIINLSNEVAPRIIPYYLEIIQKYGKRCFVWQGPTPAILITEPELIKEIFGKNYVFQKPNNPNPLTKLLARGVVSYEEEKWAKHRKILNPAFHMEKLKHMLPAFYLSCSEMLNKWEEIIPVKESNELDIWPHLQRMTSDVISRAAFGSSYEEGRRIFELQEEQAEYLTKTFNSVYIPGSRFFPNKMNKRMKECEKEVRETITCLIDNRLKAKEEGNGKALNDDLLGILLESNSIEIEEHGNKKFGMSIPEVIEECKLFYFAGQETTSVLLVWTLILLGRNPEWQERAREEVFQAFGSDKPTFDELYRLKIVTMILYESLRLYPPIATRTRRTNEETKLGELDLPKGALLFIPTILLHLDKEIWGEDADEFNPERFSEGVAKATKGKMTYFPFGAGPRKCIGQNFAILEAKMAIAMILQRFSFELSPSYTHSPYTVVTLKPKYGAPLIMHRL

SEQ ID NO: 217 - DNA, 1587 bp, Nicotiana tabacum
atgctttctcccatagaagcctttgtaggactagtaaccttcacatttctcttatacttcctatggacaaaaaaatctcaaaaacttccaaaacccttaccaccgaaaatccccggaggatggccggtaatcggccatctttttcacttcaataacgacggcgacgaccgtccattagctcgaaagctcggagacttagctgataaatacggccccgttttcacttttcggctaggtcttccccttgtgctagttgtaagcagttacgaagctataaaagattgcttctctacaaatgatgccattttctccaatcgtccagctcttctttacggcgaataccttggctacaataatacaatgctttttctagcaaattacggaccttactggcgaaaaaatcgtaaattagtcattcaggaagttctctctgctagtcgtctcgaaaaattcaaacaagtgagattcaccagaattcaaacgagcattaagaatttatacactcgaattaatggaaattcgagtacgataaatctaactgattggttagaagaattgaattttggtctgatcgtgaaaatgatcgctgggaaaaattatgaatccggtaaaggagatgaacaagtggaaagatttaagaatgcgtttaaggattttatggttttatcaatggaatttgtattatgggatgcatttccaattccattatttaaatgggtggattttcaaggtcatattaaggcaatgaaaaggacatttaaggatatagattctgtttttcagaactggttagaggaacatattaataaaagagaaaaaatagaggttggtgcagaagggaatgaacaagatttcattgatgtggtgctttcaaaattgagtaaagaatatcttgatgaaggttactctcgtgatactgtcattaaagcaacagtttttagtttggtcttggatgcagcagacacagttgctcttcacataaattggggaatgacattattgataaacaatcaaaatgccttgatgaaagcacaagaagagatagacacaaaagttggtaaggatagatgggtagaagagagtgatattaaggatttagtatacctccaagctattgttaaaaaggtgttacgattatatccaccaggacctttgttagtaccacatgaaaatgtaaaggattgtgttgttagtggatatcacattcctaaagggactagattattcgcaaacgtcatgaaactgcagcgcgatcctaaactcttgtcaaatcctgataagttcgatccagagagattcatcgctggtgatattgacttccgtggtcaccactatgagtttatcccatttggttctggaagacgatcttgtccggggatgacttatgcattgcaagtggaacacctaacaatggcacatttaatccagggtttcaattacaaaactccaaatgacgaggccttggatatgaaggaaggtgcaggcataacaatacgtaaggtaaatccagtggaattgataataacgcctcgcttggcacctgagctttactaaaacctaagatgtttcatcttggttgatcattgt

SEQ ID NO: 218 - protein, 517 aa, Nicotiana tabacum
MLSPIEAFVGLVTFTFLLYFLWTKKSQKLPKPLPPKIPGGWPVIGHLFHFNNDGDDRPLARKLGDLADKYGPVFTFRLGLPLVLVVSSYEAIKDCFSTNDAIFSNRPALLYGEYLGYNNTMLFLANYGPYWRKNRKLVIQEVLSASRLEKFKQVRFTRIQTSIKNLYTRINGNSSTINLTDWLEELNFGLIVKMIAGKNYESGKGDEQVERFKNAFKDFMVLSMEFVLWDAFPIPLFKWVDFQGHIKAMKRTFKDIDSVFQNWLEEHINKREKIEVGAEGNEQDFIDVVLSKLSKEYLDEGYSRDTVIKATVFSLVLDAADTVALHINWGMTLLINNQNALMKAQEEIDTKVGKDRWVEESDIKDLVYLQAIVKKVLRLYPPGPLLVPHENVKDCVVSGYHIPKGTRLFANVMKLQRDPKLLSNPDKFDPERFIAGDIDFRGHHYEFIPFGSGRRSCPGMTYALQVEHLTMAHLIQGFNYKTPNDEALDMKEGAGITIRKVNPVELIITPRLAPELY

SEQ ID NO: 219 - DNA, 1634 bp, Nicotiana tabacum
gggagaaggccttcaatatggagataccatattacagcttaaaaattgcaatttcttcatttgcaattatctttgtactaagatgggcatggaaaatcttgaattatgtgtggttaaaaccaaaagaattggagaaatacctcagacagcagggtttcaaaggaaactcttacaaattcttgtttggggatatgaaagagacgaagaaaatgggtgaagaagctatgtctaagccaatcaatttctctcatgacatgatttggcctagagttatgccattcatccacaaaaccatcaccaattatggtaagaattgtattgtgtggtttgggccaagaccagcagtcctgatcacagacccggaacttgtaaaggaggtgctaacgaagaatttcgtctatcagaagccgcttggcaatccactcacaaagttggcagcaactggaattgcaggctatgaaacagataaatgggctacacatagaaggcttctcaatcctgcttttcaccttgacaagttgaagcatatgctacctgcattccaatttactgctagtgagatgttgagcaaattggagaaagttgtttcaccaaacggaacagagatagatgtgtggccatatttacaaactttgacaagtgatgccatttcaagaactgcgtttggaagtagttatgaagaaggaagaaagatttttgaccttcaaaaagaacaactttcactaattctagaagtttcacgcacaatatatattccaggatggaggtttttgccaacgaaaaggaacaaaaggatgaagcaaatatttaatgaagtacgagcactggtatttggaattattaagaaaaggatgagtatgattgaaaatggagaagcacctgatgatttattgggaatattattggcatccaatttaaaagaaatccaacaacatggaaacaacaagaaatttggtatgagtattgatgaggtgattgaagagtgtaaactcttctattttgctgggcaagagactacttcatctttacttgtatggactatgattttgttgtgcaaatatcctaattggcaagataaagctagagaagaggttttgcaagtgtttgggagtagggaagttgactatgacaagttgaatcagctaaaaatagtaactatgatcttaaacgaggtcttaaggttgtatccagcaggatatgtgattaatcgaatggtaaacaaagaaacaaagttagggaatttgtgtttaccagccggcgtacagctcgtgttaccaacaatgttgttgcaacatgatactgaaatatggggagatgatgcaatggagttcaatccagagagatttagtgatggaatatccaaagcaacaaaaggaaaacttgtgttttttccatttagttggggtccaagaatatgtattgggcaaaattttgctatgttagaggctaaaatggcaatggctatgattctgaaaacctatgcatttgaactctctccatcttatgctcatgctcctcatccactactacttcaacctcaatatggtgctcaattaattttgtacaagttgtagatatggtcaatctggaacttgttatggaacttttatcatcgtaatcaaccatattgaggg

SEQ ID NO: 220 - protein, 518 aa, Nicotiana tabacum
MEIPYYSLKIAISSFAIIFVLRWAWKILNYVWLKPKELEKYLRQQGFKGNSYKFLFGDMKETKKMGEEAMSKPINFSHDMIWPRVMPFIHKTITNYGKNCIVWFGPRPAVLITDPELVKEVLTKNFVYQKPLGNPLTKLAATGIAGYETDKWATHRRLLNPAFHLDKLKHMLPAFQFTASEMLSKLEKVVSPNGTEIDVWPYLQTLTSDAISRTAFGSSYEEGRKIFDLQKEQLSLILEVSRTIYIPGWRFLPTKRNKRMKQIFNEVRALVFGIIKKRMSMIENGEAPDDLLGILLASNLKEIQQHGNNKKFGMSIDEVIEECKLFYFAGQETTSSLLVWTMILLCKYPNWQDKAREEVLQVFGSREVDYDKLNQLKIVTMILNEVLRLYPAGYVINRMVNKETKLGNLCLPAGVQLVLPTMLLQHDTEIWGDDAMEFNPERFSDGISKATKGKLVFFPFSWGPRICIGQNFAMLEAKMAMAMILKTYAFELSPSYAHAPHPLLLQPQYGAQLILYKL

SEQ ID NO: 221 - DNA, 1593 bp, Nicotiana tabacum
atggtttttcccatagaagcctttgtaggactagtaaccttcacatttctcttatacttcctatggacaaaaaaatctcaaaaacttccaaaacccttaccaccgaaaatccccggaggatggccggtaatcggccacctttttcacttcaataacgacggcgacgaccgtccattagctcgaaaactcggagacttagctgataaatacggccccgttttcacttttcggctaggtcttccccttgtgctagttgtaagcagttacgaagctacaaaagattgcttctctacaaatgacgccattttctccaatcgtccagcttttctttacggcgaataccttggctacaataatacaatgctttttctagcaaattacggaccttactggcgaaaaaatcgtaaattagtcattcaggaagttctctctgctagtcgtctcgaaaaattcaaacaagtgagattcaccagaattcaaacgagcattaagaatttatacactcgaattaatggaaattcgagtacgataaatctaactgattggttagaagaattgaattttggtctgatcgtgaaaatgatcgctgggaaaaattatgaatccggtaaaggagatgaacaagtggaaagatttaagaatgcgtttaaggattttatggttttatcaatggaatttgtattatgggatgcatttccaattccattatttaaatgggtggattttcaaggtcatattaagacaatgaaaaggacatttaaggatatagattctgtttttcagaactggttagaggaacatattaataaaagagaaaaaatggaggttggtgcagaagggaatgaacaagatttcattgatgtggtgctttcaaaattgagtaaagaatatcttgatgaaggttactctcgtgatactgtcattaaagcaacagtttttagtttggtcttggatgcagcagacacagttgctcttcacataaattggggaatgacattattgataaacaatcaaaatgccttgatgaaagcacaagaagagatagacacaaaagttggtaaggatagatgggtagaagagagtgatattaaggatttagtatacctccaagctattgttaaaaaggtgttacgattatatccaccaggacctttgttagtaccacatgaaaatgtaaaggattgtgttgttagtggatatcacattcctaaagggactagattattcgcaaacgtcatgaaactgcagcgcgatcctaaactcttgtcaaatcctgataagttcgatccagagagattcatcgctggtgatattgacttccgtggtcaccactatgagtttatcccatctggttctggaagacgatcttgtccggggatgacttatgcattgcaagtggaacacctaacaatggcacatttaatccagggtttcaattacaaaactccaaatgacgaggtcttggatatgaaggaaggtgcaggcataacaatacgtaaggtaaatccagtggaattgataataacgcctcgcttggcacctgagctttactaaaacctaagatctttcatcttggttgatcattgtttaata

SEQ ID NO: 222 - protein, 517 aa, Nicotiana tabacum
MVFPIEAFVGLVTFTFLLYFLWTKKSQKLPKPLPPKIPGGWPVIGHLFHFNNDGDDRPLARKLGDLADKYGPVFTFRLGLPLVLVVSSYEATKDCFSTNDAIFSNRPAFLYGEYLGYNNTMLFLANYGPYWRKNRKLVIQEVLSASRLEKFKQVRFTRIQTSIKNLYTRINGNSSTINLTDWLEELNFGLIVKMIAGKNYESGKGDEQVERFKNAFKDFMVLSMEFVLWDAFPIPLFKWVDFQGHIKTMKRTFKDIDSVFQNWLEEHINKREKMEVGAEGNEQDFIDVVLSKLSKEYLDEGYSRDTVIKATVFSLVLDAADTVALHINWGMTLLINNQNALMKAQEEIDTKVGKDRWVEESDIKDLVYLQAIVKKVLRLYPPGPLLVPHENVKDCVVSGYHIPKGTRLFANVMKLQRDPKLLSNPDKFDPERFIAGDIDFRGHHYEFIPSGSGRRSCPGMTYALQVEHLTMAHLIQGFNYKTPNDEVLDMKEGAGITIRKVNPVELIITPRLAPELY

SEQ ID NO: 223 - DNA, 1580 bp, Nicotiana tabacum
atgctttctcccatagaagccattgtaggactagtaaccttcacatttctcttcttcttcctatggacaaaaaaatctcaaaaaccttcaaaacccttaccaccgaaaatccccggaggatggccggtaatcggccatcttttccacttcaatgacgacggcgacgaccgtccattagctcgaaaactcggagacttagctgacaaatacggccccgttttcacttttcggctaggccttccccttgtcttagttgtaagcagttacgaagctgtaaaagactgtttctccacaaatgacgccattttttccaatcgtccagcttttctttacggcgattaccttggctacaataatgccatgctatttttggccaattacggaccttactggcgaaaaaatcgaaaattagttattcaggaagttctctccgctagtcgtctcgaaaaattcaaacacgtgagatttgcaagaattcaagcgagcatgaagaatttatatactcgaattgatggaaattcgagtacgataaatttaactgattggttagaagaattgaattttggtctgatcgtgaagatgatcgctggaaaaaattatgaatccggtaaaggagatgaacaagtggagagatttaagaaagcgtttaaggattttatgattttatcaatggagtttgtgttatgggatgcatttccaattccattatttaaatgggtggattttcaagggcatgttaaggctatgaaaaggacttttaaagatatagattctgtttttcagaattggttagaggaacatattaataaaagagaaaaaatggaggttaatgcagaagggaatgaacaagatttcattgatgtggtgctttcaaaaatgagtaatgaatatcttggtgaaggttactctcgtgatactgtcattgaagcaacggtgtttagtttggtcttggatgcagcagacacagttgctcttcacataaattggggaatggcattattgataaacaatcaaaaggccttgacgaaagcacaagaagagatagacacaaaagtttgtaaggacagatgggtagaagagagtgatattaaggatttggtatacctccaagctattgttaaagaagtgttacgattatatccaccaggacctttgttagtaccacacgaaaatgtagaagattgtgttgttagtggatatcacattcctaaagggacaagattattcgcaaacgtcatgaaactgcaacgtgatcctaaactctggtctgatcctgatactttcgatccagagagattcattgctactgatattgactttcgtggtcagtactataagtatatcccgtttggtcctggaagacgatcttgtccagggatgacttatgcattgcaagtggaacacttaacaatggcacatttgatccaaggtttcaattacagaactccaaatgacgagcccttggatatgaaggaaggtgcaggcataactatacgtaaggtaaatcctgtggaactgataatagcgcctcgcctggcacctgagctttattaaaacctaagatgtttcatcttggttga

SEQ ID NO: 224 - protein, 517 aa, Nicotiana tabacum
MLSPIEAIVGLVTFTFLFFFLWTKKSQKPSKPLPPKIPGGWPVIGHLFHFNDDGDDRPLARKLGDLADKYGPVFTFRLGLPLVLVVSSYEAVKDCFSTNDAIFSNRPAFLYGDYLGYNNAMLFLANYGPYWRKNRKLVIQEVLSASRLEKFKHVRFARIQASMKNLYTRIDGNSSTINLTDWLEELNFGLIVKMIAGKNYESGKGDEQVERFKKAFKDFMILSMEFVLWDAFPIPLFKWVDFQGHVKAMKRTFKDIDSVFQNWLEEHINKREKMEVNAEGNEQDFIDVVLSKMSNEYLGEGYSRDTVIEATVFSLVLDAADTVALHINWGMALLINNQKALTKAQEEIDTKVCKDRWVEESDIKDLVYLQAIVKEVLRLYPPGPLLVPHENVEDCVVSGYHIPKGTRLFANVMKLQRDPKLWSDPDTFDPERFIATDIDFRGQYYKYIPFGPGRRSCPGMTYALQVEHLTMAHLIQGFNYRTPNDEPLDMKEGAGITIRKVNPVELIIAPRLAPELY

SEQ ID NO: 225 - DNA, 1639 bp, Nicotiana tabacum
tttcatatacctttagtactcttgaaattttcaaataatggtttatcttctttctcccatagaagccattgtaggatttgtaaccttttcatttctattctactttctatggaccaaaaaacaatcaaaaatcttaaacccactacctccaaaaatcccaggtggatggccagtaatcggccatctcttttatttcaagaacaatggcgatgaagatcgccatttttctcaaaaactcggtgacttagctgacaaatatggtcccgtcttcactttccggttagggtttcgccgtttcttggcggtgagtagttatgaagctatgaaagaatgcttcactaccaatgatatccatttcgccgatcggccatctttactctacggagaatacctttgctataataacgccatgcttgctgttgccaaatatggcccttactggaaaaaaaatcgaaagttagtcaatcaagaagttctctccgttagtcggctcgaaaaattcaaacatgttagattttctataattcagaaaaatattaaacaattgtataattgtgattcaccaatggtgaagataaaccttagtgattggatagataaattgacattcgacatcattttgaaaatggttgttgggaagaactataataatggacatggagaaatactcaaagttgcttttcagaaattcatggttcaagctatggagatggagctctatgatgtttttcacattccatttttcaagtggttggatcttacagggaatattaaggctatgaaacaaactttcaaagacattgataatattatccaaggttggttagatgagcacattaagaagagagaaacaaaggatgttggaggtgaaaacgaacaagattttatagatgtggtgctttccaagatgagcgacgaacatcttggcgagggttactctcatgacacaaccatcaaagcaactgtattcactttggtcttggatgcaacagacacacttgcacttcatataaagtgggtaatggcgttaatgataaacaataagcatgtcatgaagaaagcacaagaagagatggacacaattgttggtagagatagatgggtagaagagagtgatatcaagaatttggtgtatctccaagcaattgtcaaagaagtattacgattacatccacccgcacctttgtcagtgcaacacctatctgtagaagattgtgttgtcaatgggtaccatattcctaaggggactgcactacttaccaatattatgaaactacagcgagatcctcaaacatggccaaatcctgataaattcgatccagagagattcctgacgactcatgctactattgactaccgcgggcagcactatgagtcgatcccctttggtacggggagacgagcttgtcccgcgatgaattattcattgcaagtggaacacctttcaattgctcatatgatccaaggtttcagttttgcaactacgaccaatgagcctttggatatgaaacaaggtgtgggtttaactttaccaaagaagactgatgttgaagtgctaattacacctcgccttcctcctacgctttatcaatattaagatgttttgttgtcgggattcgttctgatcaatccctcaatg

SEQ ID NO: 226 - protein, 519 aa, Nicotiana tabacum
MVYLLSPIEAIVGFVTFSFLFYFLWTKKQSKILNPLPPKIPGGWPVIGHLFYFKNNGDEDRHFSQKLGDLADKYGPVFTFRLGFRRFLAVSSYEAMKECFTTNDIHFADRPSLLYGEYLCYNNAMLAVAKYGPYWKKNRKLVNQEVLSVSRLEKFKHVRFSIIQKNIKQLYNCDSPMVKINLSDWIDKLTFDIILKMVVGKNYNNGHGEILKVAFQKFMVQAMEMELYDVFHIPFFKWLDLTGNIKAMKQTFKDIDNIIQGWLDEHIKKRETKDVGGENEQDFIDVVLSKMSDEHLGEGYSHDTTIKATVFTLVLDATDTLALHIKWVMALMINNKHVMKKAQEEMDTIVGRDRWVEESDIKNLVYLQAIVKEVLRLHPPAPLSVQHLSVEDCVVNGYHIPKGTALLTNIMKLQRDPQTWPNPDKFDPERFLTTHATIDYRGQHYESIPFGTGRRACPAMNYSLQVEHLSIAHMIQGFSFATTTNEPLDMKQGVGLTLPKKTDVEVLITPRLPPTLYQY

SEQ ID NO: 227 - DNA, 1610 bp, Nicotiana tabacum
ctttttctccccaaaaaagagctcatttcccttgtccccaaaaatggatcttctcttactagagaagaccttaattggtctcttctttgccattttaatcgctataattgtctctagacttcgttcaaagcgttttaagcttcccccaggaccaatcccagtaccagtttttggtaattggcttcaagttggtgatgatttaaaccacagaaatcttactgattttgccaaaaaatttggtgatcttttcttgttaagaatgggccagcgtaatttagttgttgtgtcatctcctgaattagctaaagaagttttacacacacaaggtgttgaatttggttcaagaacaagaaatgttgtatttgatatttttactggaaaaggtcaagatatggtttttactgtatatggtgaacactggagaaaaatgaggagaattatgactgtaccattttttactaataaagttgtgcagcaatatagaggggggtgggagtttgaagtggcaagtgtaattgaggatgtgaagaaaaatcctgaatctgctactaatgggattgtattaaggaggagattacaattgatgatgtataataatatgtttaggattatgtttgataggagatttgagagtgaagatgatcctttgtttgttaagcttaaggctttgaatggtgaaaggagtagattggctcagagttttgagtataattatggtgattttattcccattttgaggccttttttgagaggttatttgaagatctgtaaagaagttaaggagaagaggctgcagcttttcaaagattactttgttgatgaaagaaagaagctttcaaataccaagagcttggacagcaatgctctgaaatgtgcgattgatcacattcttgaggctcaacagaagggggagatcaatgaggacaacgttctttacattgttgaaaacatcaatgttgctgctatagaaaccacattatggtcaattgagtggggtatcgccgagttagtcaaccaccctcacatccaaaagaaactccgcgacgagattgacacagttcttggcccaggagtgcaagtgactgaaccagacacccacaagcttccataccttcaggctgtgatcaaggagacgcttcgtctccgtatggcaattcctctattagtcccacacatgaaccttcacgatgcaaagcttggcgggtttgatattccagcagagagcaaaatcttggttaacgcttggtggctagctaacaacccggctcattggaagaaacccgaagagttcagacccgagaggttcttcgaagaggagaagcacgttgaggccaatggcaatgacttcagatatcttccgtttggcgttggtaggaggagttgccctggaattatacttgcattgccaattcttggcattactttgggacgtttggttcagaactttgagctgttgcctcctccaggccagtcgaagctcgacaccacagagaaaggtggacagttcagtctccatattttgaagcattccaccattgtgttgaaaccaaggtcttgctgaactttctgatcctaatcaattaaggggttgaagaaattttataattatg

SEQ ID NO: 228 - protein, 505 aa, Nicotiana tabacum
MDLLLLEKTLIGLFFAILIAIIVSRLRSKRFKLPPGPIPVPVFGNWLQVGDDLNHRNLTDFAKKFGDLFLLRMGQRNLVVVSSPELAKEVLHTQGVEFGSRTRNVVFDIFTGKGQDMVFTVYGEHWRKMRRIMTVPFFTNKVVQQYRGGWEFEVASVIEDVKKNPESATNGIVLRRRLQLMMYNNMFRIMFDRRFESEDDPLFVKLKALNGERSRLAQSFEYNYGDFIPILRPFLRGYLKICKEVKEKRLQLFKDYFVDERKKLSNTKSLDSNALKCAIDHILEAQQKGEINEDNVLYIVENINVAAIETTLWSIEWGIAELVNHPHIQKKLRDEIDTVLGPGVQVTEPDTHKLPYLQAVIKETLRLRMAIPLLVPHMNLHDAKLGGFDIPAESKILVNAWWLANNPAHWKKPEEFRPERFFEEEKHVEANGNDFRYLPFGVGRRSCPGIILALPILGITLGRLVQNFELLPPPGQSKLDTTEKGGQFSLHILKHSTIVLKPRSC

SEQ ID NO: 229 - DNA, 1595 bp, Nicotiana tabacum
aacaataaaaatggagacattatttaacatcaaagttgcagtttcattagtaattgtgataatttttctgagatgggtatggaaattcttgaattgggtgtggattcaaccaaagaaaatggaaaaaagactaaaaatggaaggtttcaaaggaagctcatataagctattatttggagatatgaaagaaataaatacaatggttgaagaagccaaaaccaagcctatgaattttaccaatgattatgtggctagagtcttgcctcacttcacaaagttgatgctccaatatggcaagaatagctttatgtggttagggccaaaaccaacaatgtttatcacagaccctgaactaataagggagatcttgtcaaaaagttacatataccaggagattcaaggcaatccaatcactaagttgctagcacaaggactagtaagttatgaagcagagaaatgggctaagcatagaaaaattatcaatcctgcatttcaccttgacaagttgaagcatatgctaccatcattctacttgagttgttgtgacatgctcagaaaatgggaaagtatagcttcatcagagggatcagaaatagacgtgtggccttttctggaaacgttgacaagcgatgctatttcaagaacagcttttggtagtaactatgaagacgggagacagatatttgagcttcaaaaagaacaagctgagttgattttacaagcagcgcgatggctttacatccccggatggaggtttgtgccaacaaagaggaacaagaggatgaagcaaatcgctaaagaagtacgatcattagtgttgggaataatcaataagagaataagggaaatgaaagcaggggaagctgcaaaagatgacttactgggaatactattggaatctaatttcaaagaaatccaaatgcacggaaacaagaactttggcatgactatcgacgaagtgattgaagagtgcaagttattttactttgctgggcaagaaactacttcagttttgcttgtttggactttgattttactgagtaagcatgtcgattggcaagaaagagctagagaagaagttcatcaagtctttggaagtaacaaacctgattatgacgcattgaatcagttgaaagttgtaacgatgatattcaacgaggttttaaggttgtacccaccgggaattaccataagtcgaactgtacacgaggataccaaattagggaacttgtcattgccagcagggatacagcttgtgttacctgcaatttggttgcatcatgacaatgaaatatggggagatgatgcaaaggagttcaaaccagagaggtttagtgaaggagttaataaagcaacaaagggtaaatttgcatattttccatttagttggggaccaagaatatgtgttggactgaattttgcaatgttagaggcaaaaatggcacttgcattgattctacaacactatgcttttgagctctctccatcttatgcacatgctcctcatacaattatcactctgcaacctcaacatggtgctcctttgattttgcgcaagctgtagcgcggatatattgattggttatctactgtag

SEQ ID NO: 230 - protein, 517 aa, Nicotiana tabacum
METLFNIKVAVSLVIVIIFLRWVWKFLNWVWIQPKKMEKRLKMEGFKGSSYKLLFGDMKEINTMVEEAKTKPMNFTNDYVARVLPHFTKLMLQYGKNSFMWLGPKPTMFITDPELIREILSKSYIYQEIQGNPITKLLAQGLVSYEAEKWAKHRKIINPAFHLDKLKHMLPSFYLSCCDMLRKWESIASSEGSEIDVWPFLETLTSDAISRTAFGSNYEDGRQIFELQKEQAELILQAARWLYIPGWRFVPTKRNKRMKQIAKEVRSLVLGIINKRIREMKAGEAAKDDLLGILLESNFKEIQMHGNKNFGMTIDEVIEECKLFYFAGQETTSVLLVWTLILLSKHVDWQERAREEVHQVFGSNKPDYDALNQLKVVTMIFNEVLRLYPPGITISRTVHEDTKLGNLSLPAGIQLVLPAIWLHHDNEIWGDDAKEFKPERFSEGVNKATKGKFAYFPFSWGPRICVGLNFAMLEAKMALALILQHYAFELSPSYAHAPHTIITLQPQHGAPLILRKL

SEQ ID NO: 231 - DNA, 1673 bp, Nicotiana tabacum; identical to SEQ ID NO: 211

SEQ ID NO: 232 - protein, 514 aa, Nicotiana tabacum; identical to SEQ ID NO: 212

SEQ ID NO: 233 - DNA, 1601 bp, Nicotiana tabacum
gaattatttcacgtgttgtattccttgtctatgataggaagctcgttacctcagcgtacaaaccccaaataaaaaatgaatttccttgtggtgttagcttctctctttctctttgtgttcctaatgaggataagcaaagcaaaaaagctccctccaggtccaaggaaactgcctataataggaaaccttcatcaaattggaaaattacctcatcgttcacttcaaaaactttctaatgaatatggggatttcattttcttgcaattaggttctgtaccgactgtggttgtctcctcagctgacattgcccgagagatctttagaactcacgaccttgttttctcaggccgtcctgctttatatgctgccagaaaactttcctacaattgctacaacgtttcatttgcaccctatggtaattactggagagaggctcggaaaattctagtgttggagttgctaagtacaaagagagtacaaagtttcgaggcaattcgagacgaggaagtaagtagcttggttcaaattatctgtagttccttgagctcacctgttaacataagcacattagcactatccttggcaaataacgttgtttgtcgagtggcttttgggaaagggagtgctgaaggaggaaatgattatgaggataggaagtttaatgaaattctatatgagacacaagaattattgggtgagtttaacgttgctgattattttcctcggatggcatggattaacaaaataaatgggtttgatgaacgattggaaaataattttagggaattggataagttttatgacaaagtaatagaagatcatcttaattcatgtagctggatgaaacaaagggatgatgaagacgttattgatgtattgcttcgaattcaaaaggatccaagccaagaaattcctctcaaagatgatcacattaagggccttcttgcggatatattcatagctggaactgatacatcatcaacaaccatagaatgggcaatgtcagaactcataaaaaatccaagagtcttgagaaaagctcaagaggaagttagagaagtttctaagggaaaacaaaaggtccaagaaagtgatctttgcaaactagattacttgaaattggtcatcaaagaaacctttagactacacccaccagtcccattactagtccctcgagtaacaacagccagctgcaaaataatggaatacgaaattccagtaaatacaagagtcttcatcaacgcgacagcaaatgggacaaatccaaaatactgggaaaatccattgacattcttgccagagagattcttggataaggagattgattacagaggcaaaaattttgagttgttgccatttggggcagggagaagagggtgtccaggaattaatttttcaataccacttgttgagcttgcacttgctaatctattgtttcattataattggtcacttcctgaagggatgctagctaaggatgttgatatggaagaagctttggggattaccatgcacaagaaatctcccctttgcttagtagcttctcattatacttgttgagattttaaaagattttagcatagctatatatagcttgaagt

SEQ ID NO: 234 - protein, 494 aa, Nicotiana tabacum
MNFLVVLASLFLFVFLMRISKAKKLPPGPRKLPIIGNLHQIGKLPHRSLQKLSNEYGDFIFLQLGSVPTVVVSSADIAREIFRTHDLVFSGRPALYAARKLSYNCYNVSFAPYGNYWREARKILVLELLSTKRVQSFEAIRDEEVSSLVQIICSSLSSPVNISTLALSLANNVVCRVAFGKGSAEGGNDYEDRKFNEILYETQELLGEFNVADYFPRMAWINKINGFDERLENNFRELDKFYDKVIEDHLNSCSWMKQRDDEDVIDVLLRIQKDPSQEIPLKDDHIKGLLADIFIAGTDTSSTTIEWAMSELIKNPRVLRKAQEEVREVSKGKQKVQESDLCKLDYLKLVIKETFRLHPPVPLLVPRVTTASCKIMEYEIPVNTRVFINATANGTNPKYWENPLTFLPERFLDKEIDYRGKNFELLPFGAGRRGCPGINFSIPLVELALANLLFHYNWSLPEGMLAKDVDMEEALGITMHKKSPLCLVASHYTC

SEQ ID NO: 235 - DNA, 1570 bp, Nicotiana tabacum
caaagactaaaagatgtcggtctttgcggttatttcattctttctacttctgttttttcttttcaaatcatatttgccctcatcgaaaacaaagaaaaattctccaccatctccttcaaagcttccgttaatcggtcacttccacaaactaggcttacaacctcaccgttctctacaaaaactatcaaatgaacatggtcccatgatgatgcttcaattcggtagcgtacctgtgcttatcgcttcatcagctgaagctgcttccgaaatcatgaaaacccaagatttgtcttttgcaaacaaacccatttcaaccattcctagcaagcttttcttcggcccaaaggacgttgccttcaccccatatggggattactggaggaatgccagaagcatttgcatgcttcagcttttgaacaacaaaagagtccagtcttttcgaaagataagggaagaagagacttctcttcttctccagaggattagggaatcgccaaattcagaagtcgatttaacggagctgttcgtttccatgactaacgacatagtttgcagggtggccttaggaaggaagtattgtgatggggaagaagggaggaaattcaagtctttgctgttagagtttgtggaattgttgggagtttttaacattggagattacatgccgtggcttgcatggatgaatcgtttcaatggtttgaatgccaaagtggataaagtggcgaaagagtttgatgcatttttggaggatgtgattgaggaacacggaggaaataagaaatcagacactgaagctgaaggggcagacttcgtggatatattattgcaggttcacaaagaaaacaaggctggttttcaagtcgaaatggatgcaatcaaagctattatcatggatatgtttgctgcgggaacagatacaacttccacgcttctagagtggacaatgaacgagctcttaagaaatccaaaaacattgaataagttgagagatgaggtgagacaagtgactcaagggaagacagaggtaacagaggatgacttagagaaaatgccgtatttaagagcagcagttaaggagagttccaggctacactctccagtgccacttctacctcgagaagcaattaaggatgcaaaggttttgggctacgatatagctgcagggactcaagtcctcgtttgtccatgggcaatctcaagagatccaaacctttgggaaaatccagaggagtttcaacctgaaagattcttggatacttccatagattacaaaggcttacatttcgagttaattccattcggtgcaggtcggaggggttgccctggcatcacatttgctaagtttgtgaatgagctagcattggcaagattaatgttccattttgatttctcgctaccaaaaggagttaagcatgaggatttggacgtggaggaagctgctggaattactgttagaaggaagttcccccttttagccgtcgccactccatgctcgtgatttttattttagagctcattctatgccttaaaaactactactagataactgcgtagtaaataatgcttggta

SEQ ID NO: 236 - protein, 494 aa, Nicotiana tabacum
MSVFAVISFFLLLFFLFKSYLPSSKTKKNSPPSPSKLPLIGHFHKLGLQPHRSLQKLSNEHGPMMMLQFGSVPVLIASSAEAASEIMKTQDLSFANKPISTIPSKLFFGPKDVAFTPYGDYWRNARSICMLQLLNNKRVQSFRKIREEETSLLLQRIRESPNSEVDLTELFVSMTNDIVCRVALGRKYCDGEEGRKFKSLLLEFVELLGVFNIGDYMPWLAWMNRFNGLNAKVDKVAKEFDAFLEDVIEEHGGNKKSDTEAEGADFVDILLQVHKENKAGFQVEMDAIKAIIMDMFAAGTDTTSTLLEWTMNELLRNPKTLNKLRDEVRQVTQGKTEVTEDDLEKMPYLRAAVKESSRLHSPVPLLPREAIKDAKVLGYDIAAGTQVLVCPWAISRDPNLWENPEEFQPERFLDTSIDYKGLHFELIPFGAGRRGCPGITFAKFVNELALARLMFHFDFSLPKGVKHEDLDVEEAAGITVRRKFPLLAVATPCS

SEQ ID NO: 237 - DNA, 1585 bp, Nicotiana tabacum
attatccatcacctaaaatggagaattcttgggtttttctagccttggcagggctatctgcattagcttttctctgtaaaataatcacctgtcgaagaccggttaaccggaaaataccaccaggtccaaaaccatggcccatcattggcaatttgaacctacttggtcctataccacatcaatcttttgacttgctttccaaaaaatatggagagttgatgctgctgaaatttggctccaggccagttcttgttgcttcatctgctgaaatggcaaaacagtttttaaaagtacatgatgctaatttcgcctcccgtcctatgctagctggtggaaagtatacaagctataactattgtgacatgacatgggcaccctatggtccctattggcgccaagcacgacgaatttaccttaaccagatatttactccgaaaaggctagactcgttcgagtacattcgtgttgaagaaaggcaggccttgatttcccagctgaattcccttgctggaaagccattttttctcaaagaccatttgtcgcgatttagcctctgcagcatgacaaggatggttttgagcaacaagtactttggtgaatcaacagttagagtagaagatttgcagtacctggtagatcaatggttcttacttaatggtgctttcaacattggagattggattccatggctcagcttcttggacctacaaggctatgtgaaacaaatgaaggctttgaaaagaacttttgataagttccacaacattgtgctagatgatcgcagggctaagaagaatgcagagaagaactttgtcccaaaagacatggttgatgtcttgttgaagatggctgaagatcctaatctggaagtcaaactcactaatgactgtgtcaaagggttaatgcaggatttactaactggaggaacagatagcttaacagcagcagtgcaatgggcatttcaagaacttcttagacggccaagggttattgagaaggcaaccgaagagcttgaccggattgtcgggaaagagagatgggtagaagagaaagattgctcgcagctatcttacgttgaagcaatcctcaaggaaacactaaggttacatcctctaggaactatgctagcaccgcattgtgctatagaagattgtaacgtggctggttatgacatacagaaaggaacgaccgttctggtgaatgtttggaccattggaagggacccaaaatactgggatagagcacaagagtttctccccgagagattcttagagaacgacattgatatggacggacataactttgctttcttgccatttggctcggggcgaaggaggtgccctggctatagccttggacttaaggttatccgagtaacattagccaacatgttgcatggattcaactggaaattacctgaaggtatgaagccagaagatataagtgtggaagaacattatgggctcactacacatcctaagtttcctgttcctgtgatcttggaatctagactttcttcagatctctattcccccatcacttaatcctaagtgcttcctattatagcatcatatcaatatccctc

SEQ ID NO: 238 - protein, 508 aa, Nicotiana tabacum
MENSWVFLALAGLSALAFLCKIITCRRPVNRKIPPGPKPWPIIGNLNLLGPIPHQSFDLLSKKYGELMLLKFGSRPVLVASSAEMAKQFLKVHDANFASRPMLAGGKYTSYNYCDMTWAPYGPYWRQARRIYLNQIFTPKRLDSFEYIRVEERQALISQLNSLAGKPFFLKDHLSRFSLCSMTRMVLSNKYFGESTVRVEDLQYLVDQWFLLNGAFNIGDWIPWLSFLDLQGYVKQMKALKRTFDKFHNIVLDDRRAKKNAEKNFVPKDMVDVLLKMAEDPNLEVKLTNDCVKGLMQDLLTGGTDSLTAAVQWAFQELLRRPRVIEKATEELDRIVGKERWVEEKDCSQLSYVEAILKETLRLHPLGTMLAPHCAIEDCNVAGYDIQKGTTVLVNVWTIGRDPKYWDRAQEFLPERFLENDIDMDGHNFAFLPFGSGRRRCPGYSLGLKVIRVTLANMLHGFNWKLPEGMKPEDISVEEHYGLTTHPKFPVPVILESRLSSDLYSPIT

SEQ ID NO: 239 - DNA, 1591 bp, Nicotiana tabacum
ctcattatccatcacctaaaatggagaattcttgggtttttctagccttggcagggctatctgcattagcttttctctgtaaaataatcacctgtcgaagaccggttaaccggaaaataccaccaggtccaaaaccatggcccatcattggcaatttgaacctacttggtcctataccacatcaatcttttgacttgctttccaaaaaatatggagagttgatgctgctgaaatttggctccaggccagttcttgttgcttcatctgctgaaatggcaaaacagtttttaaaagtacatgatgctaatttcgcctcccgtcctatgctagctggtggaaagtatacaagctataactattgtgacatgacatgggcaccctatggtccctattggcgccaagcacgacgacgaatttaccttaaccagatatttactccgaaaaggctagactcgttcgagtacattcgtgttgaagaaaggcaggccttgatttcccagctgaattcccttgctggaaagccattttttctcaaagaccatttgtcgcgatttagcctctgcagcatgacaaggatggttttgagcaacaagtattttggtgaatcaacagttagagtagaagatttgcagtacctggtagatcaatggttcttacttaatggtgctttcaacattggagattggattccatggctcagcttcttggacctacaaggctatgtgaaacaaatgaaggctttgaaaagaacttttgataagttccacaacattgtgctagatgatcacagggctaagaagaatgcagagaagaactttgtcccaaaagacatggttgatgtcttgttgaagatggctgaagatcctaatctggaagtcaaactcactaatgactgtgtcaaagggttaatgcaggatttactaactggaggaacagatagcttaacagcagcagtgcaatgggcatttcaagaacttcttagacagccaagggttattgagaaggcaaccgaagagcttgaccggattgtcgggaaagagagatgggtagaagagaaagattgctcgcagctatcttacgttgaagcaatcctcaaggaaacactaaggttacatcctctaggaactatgctagcaccgcattgtgctatagaagattgtaacgtggctggttatgacatacagaaaggaacgaccgttctggtgaatgtttggaccattggaagggacccaaaatactgggatagagcacaagagtttctccccgagagattcttagagaacgacattgatatggacggacataactttgctttcttgccatttggctcggggcgaaggaggtgccctggctatagccttggacttaaggttatccgagtaacattagccaacatgttgcatggattcaactggaaattacctgaaggtatgaagccagaagatataagtgtggaagaacattatgggctcactacacatcctaagtttcctgttcctgtgatcttggaatctagactttcttcagatctctattcccccatcacttaatcctaagtgcttcctattatagcatcatatcaatatccctc

SEQ ID NO: 240 - protein, 509 aa, Nicotiana tabacum
MENSWVFLALAGLSALAFLCKIITCRRPVNRKIPPGPKPWPIIGNLNLLGPIPHQSFDLLSKKYGELMLLKFGSRPVLVASSAEMAKQFLKVHDANFASRPMLAGGKYTSYNYCDMTWAPYGPYWRQARRRIYLNQIFTPKRLDSFEYIRVEERQALISQLNSLAGKPFFLKDHLSRFSLCSMTRMVLSNKYFGESTVRVEDLQYLVDQWFLLNGAFNIGDWIPWLSFLDLQGYVKQMKALKRTFDKFHNIVLDDHRAKKNAEKNFVPKDMVDVLLKMAEDPNLEVKLTNDCVKGLMQDLLTGGTDSLTAAVQWAFQELLRQPRVIEKATEELDRIVGKERWVEEKDCSQLSYVEAILKETLRLHPLGTMLAPHCAIEDCNVAGYDIQKGTTVLVNVWTIGRDPKYWDRAQEFLPERFLENDIDMDGHNFAFLPFGSGRRRCPGYSLGLKVIRVTLANMLHGFNWKLPEGMKPEDISVEEHYGLTTHPKFPVPVILESRLSSDLYSPIT

SEQ ID NO: 241 - DNA, 1615 bp, Nicotiana tabacum
tgataatgctctttctactctttgtagcccttcctttcattcttatttttcttcttcctaaattcaaaaatggtggaaataacagattgccaccaggtcctataggtttaccattcattggaaatttgcatcaatacgatagtataactcctcatatctatttttggaaactttcaaaaaaatatggcaaaatcttctcattaaaacttgcttctactaatgtggtagtagtttcttcagcaaaattagcaaaagaagtattgaaaaaacaagatttaatattttgtagtagaccatctattcttggccaacaaaaactgtcttattatggtcgtgatattgcttttaatgattattggagagaaatgagaaaaatttgtgttcttcatctttttagtttaaaaaaagttcaattatttagtccaattcgtgaagatgaagtttttagaatgattaagaaaatatcaaaacaagcttctacttcacaaattattaatttgagtaatttaatgatttcattaacaagtacaattatttgtagagttgcttttggtgttaggattgaagaagaagcacatgcaaggaagagatttgattttcttttggccgaggcacaagaaatgatggctagtttctttgtatctgatttttttccctttttaagttggattgataaattaagtggattgacatatagacttgagaggaatttcaaggatttggataatttttatgaagaactcattgagcaacatcaaaatcctaataagccaaaatatatggaaggagatattgttgatcttttgctacaattgaagaaagagaaattaacaccacttgatctcactatggaagatataaaaggaattctcatgaatgtgttagttgcaggatcagacactagtgcagctgctactgtttgggcaatgacagccttgataaagaatcctaaagccatggaaaaagttcaattagaaatcagaaaatcagttgggaagaaaggcattgtaaatgaagaagatgtccaaaacatcccttattttaaagcagtgataaaggaaatatttagattgtatccaccagctccacttttagttccaagagaatcaatggaaaaaaccatattagaaggttatgaaattcggccaagaaccatagttcatgttaacgcttgggctatagcaagggatcctgaaatatgggaaaatccagatgaatttatacctgagagatttttgaatagcagtatcgattacaagggtcaagattttgagttacttccatttggtgcaggcagaagaggttgcccaggtattgcacttggggttgcatccatggaacttgctttgtcaaatcttctttatgcatttgattgggagttgccttatggagtaaaaaaagaagacatcgacacaaacgttaggcctggaattgccatgcacaagaaaaacgaactttgccttgtcccaaaaaattatttataaattatattgggacgtggatctcatgctagttctgtgcggtcagctaagcttattatttttggctcaaattatgtatacataattagtacatgtttaaaatgtataaatatagtagaaccattctcatggtt

SEQ ID NO: 242 - protein, 492 aa, Nicotiana tabacum
MLFLLFVALPFILIFLLPKFKNGGNNRLPPGPIGLPFIGNLHQYDSITPHIYFWKLSKKYGKIFSLKLASTNVVVVSSAKLAKEVLKKQDLIFCSRPSILGQQKLSYYGRDIAFNDYWREMRKICVLHLFSLKKVQLFSPIREDEVFRMIKKISKQASTSQIINLSNLMISLTSTIICRVAFGVRIEEEAHARKRFDFLLAEAQEMMASFFVSDFFPFLSWIDKLSGLTYRLERNFKDLDNFYEELIEQHQNPNKPKYMEGDIVDLLLQLKKEKLTPLDLTMEDIKGILMNVLVAGSDTSAAATVWAMTALIKNPKAMEKVQLEIRKSVGKKGIVNEEDVQNIPYFKAVIKEIFRLYPPAPLLVPRESMEKTILEGYEIRPRTIVHVNAWAIARDPEIWENPDEFIPERFLNSSIDYKGQDFELLPFGAGRRGCPGIALGVASMELALSNLLYAFDWELPYGVKKEDIDTNVRPGIAMHKKNELCLVPKNYL

SEQ ID NO: 243 - DNA, 1624 bp, Nicotiana tabacum
tgataatgctctttctactctttgtagcccttcctttcattcttatttttcttcttcctaaattcaaaaatggtggaaataacagattgccaccaggtcctataggtttaccattcattggaaatttgcatcaatatgatagtataactcctcatatctatttttggaaactttccaaaaaatatggcaaaatcttctcattaaaacttgcttctactaatgtggtagtagtttcttcagcaaaattagcaaaagaagtattgaaaaaacaagatttaatattttgtagtagaccatctattcttggccaacaaaaactgtcttattatggtcgtgatattgcttttgcaccttataatgattattggagagaaatgagaaaaatttgtgttcttcatctttttagtttaaaaaaagttcaattatttagtccaattcgtgaagatgaagtttttagaatgattaagaaaatatcaaaacaagcttctacttcacaaattattaatttgagtaatttaatgatttcattaacaagtacaattatttgtagagttgcttttggtgttaggtttgaagaagaagcacatgcaaggaagagatttgattttcttttggccgaggcacaagaaatgatggctagtttctttgtatctgatttttttccctttttaagttggattgataaattaagtggattgacatatagacttgagaggaatttcaaggatttggataatttttatgaagaactcattgagcaacatcaaaatcctaataagccaaaatatatggaaggagatattgttgatcttttgctacaattgaagaaagagaaattaacaccacttgatctcactatggaagatataaaaggaattctcatgaatgtgttagttgcaggatcagacactagtgcagctgctactgtttgggcaatgacagccttgataaagaatcctaaagccatggaaaaagttcaattagaaatcagaaaatcagttgggaagaaaggcattgtaaatgaagaagatgtccaaaacatcccttattttaaagcagtgataaaggaaatatttagattgtatccaccagctccacttttagttccaagagaatcaatggaaaaaaccatattagaaggttatgaaattcggccaagaaccatagttcatgttaacgcttgggctatagcaagggatcctgaaatatgggaaaatccagatgaatttatacctgagagatttttgaatagcagtatcgattacaagggtcaagattttgagttacttccatttggtgcaggcagaagaggttgcccaggtattgcacttggggttgcatccatggaacttgctttgtcaaatcttctttatgcatttgattgggagttgccttatggagtgaaaaaagaagacatcgacacaaacgttaggcctggaattgccatgcacaagaaaaacgaactttgccttgtcccaaaaaattatttataaattatattgggacgtggatctcatgctagttctgtgcggtcagctaagcttattatttttggctcaaattatgtatacataattagtacatgtttaaaatgtataaatatagtagaaccattctcatggtt

SEQ ID NO: 244 - protein, 495 aa, Nicotiana tabacum
MLFLLFVALPFILIFLLPKFKNGGNNRLPPGPIGLPFIGNLHQYDSITPHIYFWKLSKKYGKIFSLKLASTNVVVVSSAKLAKEVLKKQDLIFCSRPSILGQQKLSYYGRDIAFAPYNDYWREMRKICVLHLFSLKKVQLFSPIREDEVFRMIKKISKQASTSQIINLSNLMISLTSTIICRVAFGVRFEEEAHARKRFDFLLAEAQEMMASFFVSDFFPFLSWIDKLSGLTYRLERNFKDLDNFYEELIEQHQNPNKPKYMEGDIVDLLLQLKKEKLTPLDLTMEDIKGILMNVLVAGSDTSAAATVWAMTALIKNPKAMEKVQLEIRKSVGKKGIVNEEDVQNIPYFKAVIKEIFRLYPPAPLLVPRESMEKTILEGYEIRPRTIVHVNAWAIARDPEIWENPDEFIPERFLNSSIDYKGQDFELLPFGAGRRGCPGIALGVASMELALSNLLYAFDWELPYGVKKEDIDTNVRPGIAMHKKNELCLVPKNYL

SEQ ID NO: 245 - DNA, 1627 bp, Nicotiana tabacum
aaaattcataatggtttttcccatagaagcctttgtaggactagtaaccttcacatttctcttatacttcctatggacaaaaaaatctcaaaaacttccaaaacccttactaccgaaaatccccggaggatggccggtaatcggccatctttttcacttcaataacgacggcgacgaccgtccattagctcgaaaactcggagacttagctgataaatacggccccgttttcacttttcggctaggtcttccccttgtgctagttgtaagcagttacgaagctataaaagattgcttctctacaaatgacgccattttctccaatcgtccagcttttctttacggcgaataccttggctacaataatacaatgctttttctagcaaattacggaccttactggcgaaaaaatcgtaaattagtcattcaggaagttctctctgctagtcgtctcgaaaaattcaaacaagtgagattcaccagaattcaaacgagcattaagaatttatacactcgaattaatggaaattcgagtacgataaatctaactgattggttagaagaattggattttggtctgatcgtgaaaatgatcgctgggaaaaattatgaatccggtaaaggagatgaacaagtggaaagatttaagaatgcgtttaaggattttatggttttatcaatggaatttgtattatgggatgcatttccaattccattatttaaatgggtggattttcaaggtcatattaaggcaatgaaaaggacatttaaggatatagattctgtttttcagaactggttagaggaacatattaataaaagagaaaaaatggaggttggtgcagaagggaatgaacaagatttcattgatgtggtgctttcaaaattgagtaaagaatatcttgatgaaggttactctcgtgatactgtcattaaagcaacagtttttagtttggtcttggatgcagcagacacagttgctcttcacataaattggggaatgacattattgataaacaatcaaaatgccttgatgaaagcacaagaagagatagacacaaaagttggtaagtatagatgggtagaagagagtgatattaaggatttagtatacctccaagctattgttaaaaaggtgttacgattatatccaccaggacctttgttagtaccacatgaatatgtaaaggattgtgttgttagtggatatcacattcctaaagggactagattattcgcaaacgtcatgaaactgcagcgcgatcctaaactcttgtcaaatcctgataagttcgatccagagagattcatcgctggtgatatcgacttccgtggtcaccactatgagtttatcccatttggttctggaagacgatcttgtccggggatgacttatgcattgcaagtggaacacctaacaatggcacatttaatccagggtttcaattacaaaactccaaatgacgaggccttggatatgaaggaaggtgcaggcataacaatacgtaaggtaaatccggtggaattgataataacgcctcgcttggcacctgagctttactaaaacctaagatctttcatcttggttgatcattgtttaatactcctagatagatgggtattcatc

SEQ ID NO: 246 - protein, 517 aa, Nicotiana tabacum
MVFPIEAFVGLVTFTFLLYFLWTKKSQKLPKPLLPKIPGGWPVIGHLFHFNNDGDDRPLARKLGDLADKYGPVFTFRLGLPLVLVVSSYEAIKDCFSTNDAIFSNRPAFLYGEYLGYNNTMLFLANYGPYWRKNRKLVIQEVLSASRLEKFKQVRFTRIQTSIKNLYTRINGNSSTINLTDWLEELDFGLIVKMIAGKNYESGKGDEQVERFKNAFKDFMVLSMEFVLWDAFPIPLFKWVDFQGHIKAMKRTFKDIDSVFQNWLEEHINKREKMEVGAEGNEQDFIDVVLSKLSKEYLDEGYSRDTVIKATVFSLVLDAADTVALHINWGMTLLINNQNALMKAQEEIDTKVGKYRWVEESDIKDLVYLQAIVKKVLRLYPPGPLLVPHEYVKDCVVSGYHIPKGTRLFANVMKLQRDPKLLSNPDKFDPERFIAGDIDFRGHHYEFIPFGSGRRSCPGMTYALQVEHLTMAHLIQGFNYKTPNDEALDMKEGAGITIRKVNPVELIITPRLAPELY

SEQ ID NO: 247 - DNA, 1594 bp, Nicotiana tabacum
caaaaaatcatttctctcgtctaaaatggatcttctcttactagagaagaccttaattggtcttttctttgccattttaatcgctttaattgtctctaaacttcgttcaaagcgttttaagcttcctccaggaccaattccagtaccagtttttggtaattggcttcaagttggtgatgatttaaaccacagaaatcttactgattatgccaaaaaatttggcgatcttttcttgttaagaatgggtcaacgtaacttagttgttgtgtcatctcctgaattagctaaagaagttttacacacacaaggtgttgaatttggttcaagaacaagaaatgttgtgtttgatatttttactggaaaaggtcaagatatggtttttactgtatatggtgaacattggagaaaaatgaggagaattatgactgtaccattttttactaataaagttgtgcaacagtatagaggggggtgggagtttgaggtggcaagtgtaattgaggatgtgaaaaaaaatcctgaatctgctactaatgggatcgtattaaggaggagattacaattaatgatgtataataatatgtttaggattatgtttgataggagatttgagagtgaagatgatcctttgtttgttaagcttaaggctttgaatggtgaaaggagtagattggctcaaagttttgagtataattatggtgattttattccaattttgaggcctcttttgagaggttatttgaagatctgtaaagaagttaaggagaagaggctgcagcttttcaaagattactttgttgatgaaagaaagaagctttcaaataccaagagctcggacagcaatgccctaaaatgtgcgattgatcacattcttgaggctcaacagaagggagagatcaatgaggacaacgttctttacattgttgaaaacatcaatgttgctgcaattgaaacaacattatggtcaattgagtggggtatcgccgagctagtcaaccaccctcacatccaaaagaaactgcgcgacgagattgacacagttcttggaccaggagtgcaagtgactgaaccagacacccacaagcttccataccttcaggctgtgatcaaggaggcacttcgtctccgtatggcaattcctctattagtcccacacatgaaccttcacgacgcaaagcttggcgggcttgatattccagcagagagcaaaatcttggttaacgcttggtggttagctaacaacccggctcattggaagaaacccgaagagttcagacccgagaggttctttgaagaggagaagcatgttgaggccaatggcaatgacttcagatatcttccgtttggcgttggtaggaggagctgccctggaattatacttgcattgccaattcttggcatcactttgggacgtttggttcagaactttgagctgttgcctcctccaggccagtcgaagctcgacaccacagagaaaggtggacagttcagtctccacattttgaagcattccaccattgtgttgaaaccaaggtctttctgaactttgtgatcttattaattaaggggttctgaagaaatttgatagtgttgg

SEQ ID NO: 248 - protein, 505 aa, Nicotiana tabacum
MDLLLLEKTLIGLFFAILIALIVSKLRSKRFKLPPGPIPVPVFGNWLQVGDDLNHRNLTDYAKKFGDLFLLRMGQRNLVVVSSPELAKEVLHTQGVEFGSRTRNVVFDIFTGKGQDMVFTVYGEHWRKMRRIMTVPFFTNKVVQQYRGGWEFEVASVIEDVKKNPESATNGIVLRRRLQLMMYNNMFRIMFDRRFESEDDPLFVKLKALNGERSRLAQSFEYNYGDFIPILRPLLRGYLKICKEVKEKRLQLFKDYFVDERKKLSNTKSSDSNALKCAIDHILEAQQKGEINEDNVLYIVENINVAAIETTLWSIEWGIAELVNHPHIQKKLRDEIDTVLGPGVQVTEPDTHKLPYLQAVIKEALRLRMAIPLLVPHMNLHDAKLGGLDIPAESKILVNAWWLANNPAHWKKPEEFRPERFFEEEKHVEANGNDFRYLPFGVGRRSCPGIILALPILGITLGRLVQNFELLPPPGQSKLDTTEKGGQFSLHILKHSTIVLKPRSF

SEQ ID NO: 249 - DNA, 1678 bp, Nicotiana tabacum
aacattttgcaatatagttttcctagtcagttctagcctccttttccttagaaataatggattatcatatttctttccattttcaagctcttttagggcttttagcctttgtgttcttgtctattatcttatggagaagaacactcacttcaagaaaattagcccctgaaatcccaggggcatggcctattataggccatcttcgtcagctgagtggtactgataagaatatcccatttccccgaatattgggcgctttggcagataaatatggacctgtcttcacactgagaatagggatgtacccctatttgattgtcaacaattgggaagcagctaaggattgtctcacaacgcatgataaggacttcgctgcccgaccaacttctatggctggtgaaagcatcgggtacaagtatgcgaggtttacttatgctaattttggtccttattataaccaagtgcgcaaactagccctacaacatgtaccctcgagtactaaactcgagaaaatgaaacacatacgtgtttctgaattggaaactagcatcaaagaattatattctttgacgctgggcaaaaacaacatgcaaaaagtgaatataagtaaatggtttgaacaattgactttaaacataatcgtgaagacaatttgtggcaagagatatagcaacatagaggaggatgaagaggcacaacgtttcagaaaggcatttaagggcatcatgtttgttgtagggcaaattgttttatatgacgcaattccattcccattgttcaaatactttgatttccaaggtcatatacaattgatgaacaaaatttataaagacttagattctattcttcaaggatggttggatgatcatatgatgaacaaggatgtaaacaataaggatcaagatgccatagatgccatgcttaaggtaacacaacttaatgaattcaaagcctatggtttttctcaggccactgtgatcaagtcgacagtcttgagtttgatcttagatggaaatgacacaaccgctgttcatttgatatgggtaatgtccttattactgaacaatccacatgttatgaaacaaggccaagaagagatagacatgaaagtgggtaaagagaggtggattgaagatactgacataaaaaatttagtgtaccttcaggctatcgttaaagagacattgcgcttgtatccacctgttccttttcttttaccacacgaagcagtgcaagattgtaaagtgactggttaccacattcctaaaggtactcgtctatatatcaatgcgtggaaagtacatcgcgatcctgaaatttggtcagagcccgaaaagtttatgcccaatagattcttgactagcaaagcaaatatagatgctcgcggtcaaaattttgaatttataccgtttggttctgggagacggtcatgtccagggataggttttgcgactttagtgacacatctgacttttggtcgcttgcttcaaggttttgattttagtaagccatcaaacacgccaattgacatgacagaaggcgtaggcgttactttgcctaaggttaatcaagttgaagttctaattacccctcgtttaccttctaagctttatttattttgaaagtgcaaatcatcaatcatggcttgagtaattagttatactttaatatgtttctc

SEQ ID NO: 250 - protein, 521 aa, Nicotiana tabacum
MDYHISFHFQALLGLLAFVFLSIILWRRTLTSRKLAPEIPGAWPIIGHLRQLSGTDKNIPFPRILGALADKYGPVFTLRIGMYPYLIVNNWEAAKDCLTTHDKDFAARPTSMAGESIGYKYARFTYANFGPYYNQVRKLALQHVPSSTKLEKMKHIRVSELETSIKELYSLTLGKNNMQKVNISKWFEQLTLNIIVKTICGKRYSNIEEDEEAQRFRKAFKGIMFVVGQIVLYDAIPFPLFKYFDFQGHIQLMNKIYKDLDSILQGWLDDHMMNKDVNNKDQDAIDAMLKVTQLNEFKAYGFSQATVIKSTVLSLILDGNDTTAVHLIWVMSLLLNNPHVMKQGQEEIDMKVGKERWIEDTDIKNLVYLQAIVKETLRLYPPVPFLLPHEAVQDCKVTGYHIPKGTRLYINAWKVHRDPEIWSEPEKFMPNRFLTSKANIDARGQNFEFIPFGSGRRSCPGIGFATLVTHLTFGRLLQGFDFSKPSNTPIDMTEGVGVTLPKVNQVEVLITPRLPSKLYLF

SEQ ID NO: 251 - DNA, 1537 bp, Nicotiana tabacum
tgataatgctctttctactctttgtagcccttcctttcattcttatttttcttcttcctaaattcaaaaatggtggaaataacagattgccaccaggtcctataggtttaccattcattggaaatttgcatcaatatgatagtataactcctcatatctatttttggaaactttccaaaaaatatggcaaaatcttctcattaaaacttgcttctactaatgtggtagtagtttcttcagcaaaattagcaaaagaagtattgaaaaaacaagatttaatattttgtagtagaccatctattcttggccaacaaaaactgtcttattatggtcgtgatattgcttttgcaccttataatgattattggagagaaatgagaaaaatttgtgttcttcatctttttagtttaaaaaaagttcaattatttagtccaattcgtgaagatgaagtttttagaatgattaagaaaatatcaaaacaagcttctacttcacaaattattaatttgagtaatttaatgatttcattaacaagtacaattatttgtagagttgcttttggtgttaggtttgaagaagaagcacatgcaaggaagagatttgattttcttttggccgaggcacaagaaatgatggctagtttctttgtatctgatttttttccctttttaagttggattgataaattaagtggattgacatatagacttgagaggaatttcaaggatttggataatttttatgaagaactcattgagcaacatcaaaatcctaataagccaaaatatatggaaggagatattgttgatcttttgctacaattgaagaaagagaaattaacaccacttgatctcactatggaagatataaaaggaattctcatgaatgtgttagttgcaggatcagacactagtgcagctgctactgtttgggcaatgacagccttgataaagaatcctaaagccatggaaaaagttcaattagaaatcagaaaatcagttgggaagaaaggcattgtaaatgaagaagatgtccaaaacatcccttattttaaagcagtgataaaggaaatatttagattgtatccaccagctccacttttagttccaagagaatcaatggaaaaaaccatattagaaggttatgaaattcggccaagaaccatagttcatgttaacgcttgggctatagcaagggatcctgaaatatgggaaaatccagatgaatttatacctgagagatttttgaatagcagtaccgattacaagggtcaagattttgagttacttccatttggtgcaggcagaagaggttgcccaggtattgcacttggggttgcatccatggaacttgctttgtcaaatcttctttatgcatttgattgggagttgccttatggagtgaaaaaagaagacatcgacacaaacgttaggcctggaattgccatgcacaagaaaaacgaactttgccttgtcccaaaaaattatttataaattatattgggacgtggatctcaatttagttctgtgaggtcagc

SEQ ID NO: 252 - protein, 495 aa, Nicotiana tabacum
MLFLLFVALPFILIFLLPKFKNGGNNRLPPGPIGLPFIGNLHQYDSITPHIYFWKLSKKYGKIFSLKLASTNVVVVSSAKLAKEVLKKQDLIFCSRPSILGQQKLSYYGRDIAFAPYNDYWREMRKICVLHLFSLKKVQLFSPIREDEVFRMIKKISKQASTSQIINLSNLMISLTSTIICRVAFGVRFEEEAHARKRFDFLLAEAQEMMASFFVSDFFPFLSWIDKLSGLTYRLERNFKDLDNFYEELIEQHQNPNKPKYMEGDIVDLLLQLKKEKLTPLDLTMEDIKGILMNVLVAGSDTSAAATVWAMTALIKNPKAMEKVQLEIRKSVGKKGIVNEEDVQNIPYFKAVIKEIFRLYPPAPLLVPRESMEKTILEGYEIRPRTIVHVNAWAIARDPEIWENPDEFIPERFLNSSTDYKGQDFELLPFGAGRRGCPGIALGVASMELALSNLLYAFDWELPYGVKKEDIDTNVRPGIAMHKKNELCLVPKNYL

SEQ ID NO: 253 - DNA, 1572 bp, Nicotiana tabacum
ccaaaatcatggctctatctttcatattcatatccataaccctaatttttctagttcataaactctaccaccgtcttagattcaaactaccaccaggtccgcggccgttaccggtggtcggaaacctctacgacataaaaccggtgagattccggtgctttgccgattgggccaaaacttacggtccgattttctcagtatactttgggtcacagttaaatgttgtggtaacaacagctgaattagctaaagaagtattgaaagaaaatgaccagaatttagcagatagatttaggactagacctgcaaataatttgagcagaaatgggatggatttgatttgggctgattatgggcctcattatgtgaaagtaaggaagctctgtaatcttgagctttttactcctaaaagacttgaagctcttagacctattagagaagatgaagttactgctatggttgaaaacattttcaaggattgtactaagcctgataacacaggtaaaagcttgttgataagagagtacttaggatcagtagcattcaacaacattacaaggttaacatttgggaaaaggttcatgaactcaaaaggtgagattgatgagcaaggtcaagaattcaagggtattgtctctaatggcatcaaaattggcggaaaacttcccttggcagagtatgttccatggctccgttggtttttcacaatggaaaacgaggcactcgtgaagcactctgcacgtagagaccggttaacaagaatgatcatggatgaacacacactggctcgcaagaaaactggtgatactaagcagcattttgtcgatgcattgcttactcttcagaagcagtatgatcttagtgatgacactgttattggcctcctctgggatatgattacagcaggaatggacacaacaaccataacagtggaatgggcaatggcagaactagttaagaacccaagagtgcaactaaaagctcaagaggagcttgacagggtaatcggaacggatcgaatcatgtcagaaaccgatttctctaaacttccttacctacaatgtgtagccaaagaggctctaaggttgcaccctccaactcctctaatgcttcctcataaggccagtgccagtgtcaaaattggtggttatgacattcctaaggggtccatcgtgcacgtgaacgtttgggctgtcgctcgtgacccagccgtgtggaagaacccgttggagttcagaccagagcgcttccttgaggaagacgttgacatgaagggtcacgactatcggttattgccctttggtgcaggaaggcgtgtttgccccggtgcacaacttgctatcaacttggtcacatctatgttgggtcatttgttgcatcattttacatgggctccggccccgggggttaacccggaggatattgacttggaggagagccctggaacagtaacttacatgaaaaatccaatacaagctattccaactccaagattgcctgcacacttgtatggacgtgtgccagtggatatgtaaaacattttgttctttccctttttggttatatgatgag

SEQ ID NO: 254 - protein, 508 aa, Nicotiana tabacum
MALSFIFISITLIFLVHKLYHRLRFKLPPGPRPLPVVGNLYDIKPVRFRCFADWAKTYGPIFSVYFGSQLNVVVTTAELAKEVLKENDQNLADRFRTRPANNLSRNGMDLIWADYGPHYVKVRKLCNLELFTPKRLEALRPIREDEVTAMVENIFKDCTKPDNTGKSLLIREYLGSVAFNNITRLTFGKRFMNSKGEIDEQGQEFKGIVSNGIKIGGKLPLAEYVPWLRWFFTMENEALVKHSARRDRLTRMIMDEHTLARKKTGDTKQHFVDALLTLQKQYDLSDDTVIGLLWDMITAGMDTTTITVEWAMAELVKNPRVQLKAQEELDRVIGTDRIMSETDFSKLPYLQCVAKEALRLHPPTPLMLPHKASASVKIGGYDIPKGSIVHVNVWAVARDPAVWKNPLEFRPERFLEEDVDMKGHDYRLLPFGAGRRVCPGAQLAINLVTSMLGHLLHHFTWAPAPGVNPEDIDLEESPGTVTYMKNPIQAIPTPRLPAHLYGRVPVDM

SEQ ID NO: 255 - DNA, 1580 bp, Nicotiana tabacum
aatcactaattttcatgtactctcataggtcaaaagtttcaaccaaaatcatggctctatccttcatattcatatccataaccctaatttttctagttcataaactctaccaccgtcttagattcaaactaccaccaggtccgcggccgttaccggtggtcggaaacctctacgacatagaaccggtgagattccggtgctttgccgattgggccaaaacttacggtccgattttctcagtatactttgggtcacagttaaatgttgtggtaacaacagctgaattagctaaagaagtattgaaagaaaatgaccagaatttagcagatagatttaggactagacctgcaaataatttgagcagaaatgggatggatttgatttgggctgattatgggcctcattatgtgaaagtaaggaagctctgtaatcttgagctttttactcctaaaagacttgaagctcttagacctattagagaagatgaagttactgctatggttgaaaacattttcaaggattgtactaagcctgataacacaggtaaaagcttgttgataagagagtacttaggatcagtagcattcaacaacattacaaggttaacatttgggaaaaggttcatgaactcaaaaggtgagattgatgagcaaggtcaagaattcaagggtattgtctctaatggcatcaaaattggcggaaaacttcccttggcagagtatgttccatggctccgttggtttttcacaatggaaaacgaggcactcgtgaagcactctgcacgtagagaccggttaacaagaatgatcatggatgaacacacactggctcgcaagaaaactggtgatactaagcagcattttgtcgatgcattgcttactcttcagaagcagtatgatcttagtgatgacactgttattggcctcctctgggatatgattacagcaggaatggacacaacaaccataacagtggaatgggcaatggcagaactagttaagaacccaagagtgcaactaaaagctcaagaggagcttgacagggtaatcggaacggatcgaatcatgtcagaaaccgatttctctaaacttccttacctacaatgtgtagccaaagaggctctaaggttgcaccctccaactcctctaatgcttcctcatagggccagtgccagtgtcaaaattggtggttatgacattcctaaggggtccatcgtgcacgtgaacgtttgggctgtcgctcgtgacccagccgtgtggaagaacccgttggagttcagaccagagcgcttccttgaggaagacgttgacatgaagggtcacgactatcggttattgccctttggtgcaggaaggcgtgtttgccccggtgcacaacttgctatcaacttggtcacatctatgttgggtcatttgttgcatcattttacatgggctccggccccgggggttaacccggaggatattgacttggaggagagccctggaacagtaacttacatgaaaaatccaatacaagctattccaactccaagattgcctgcacacttgtatggacgtgtgccagtggatatgtaaaac

SEQ ID NO: 256 - protein, 520 aa, Nicotiana tabacum
MYSHRSKVSTKIMALSFIFISITLIFLVHKLYHRLRFKLPPGPRPLPVVGNLYDIEPVRFRCFADWAKTYGPIFSVYFGSQLNVVVTTAELAKEVLKENDQNLADRFRTRPANNLSRNGMDLIWADYGPHYVKVRKLCNLELFTPKRLEALRPIREDEVTAMVENIFKDCTKPDNTGKSLLIREYLGSVAFNNITRLTFGKRFMNSKGEIDEQGQEFKGIVSNGIKIGGKLPLAEYVPWLRWFFTMENEALVKHSARRDRLTRMIMDEHTLARKKTGDTKQHFVDALLTLQKQYDLSDDTVIGLLWDMITAGMDTTTITVEWAMAELVKNPRVQLKAQEELDRVIGTDRIMSETDFSKLPYLQCVAKEALRLHPPTPLMLPHRASASVKIGGYDIPKGSIVHVNVWAVARDPAVWKNPLEFRPERFLEEDVDMKGHDYRLLPFGAGRRVCPGAQLAINLVTSMLGHLLHHFTWAPAPGVNPEDIDLEESPGTVTYMKNPIQAIPTPRLPAHLYGRVPVDM

SEQ ID NO: 257 - DNA, 1544 bp, Nicotiana tabacum
ataatgctctttctactctttgtagcccttcctttcattcttatttttcttcttcctaaattcaaaaatggtggaaataacagattgccaccaggtcctataggtttaccattcattggaaatttgcatcaatatgatagtataactcctcatatctatttttggaaactttccaaaaaatatggcaaaatcttctcattaaaacttgcttctactaatgtggtagtagtttcttcagcaaaattagcaaaagaagtattgaaaaaacaagatttaatattttgtagtagaccatctattcttggccaacaaaaactgtcttattatggtcgtgatattgcttttgcaccttataatgattattggagagaaatgagaaaaatttgtgttcttcatctttttagtttaaaaaaagttcaattatttagtccaattcgtgaagatgaagtttttagaatgattaagaaaatatcaaaacaagcttctacttcacaaattattaatttgagtaatttaatgatttcattaacaagtacaattatttgtagagttgcttttggtgttaggtttgaagaagaagcacatgcaaggaagagatttgattttcttttggccgaggcacaagaaatgatggctagtttctttgtatctgatttttttccctttttaagttagattgacaaattaagtggattgacatatagacttgagaggaatttcaaggatttggataatttttatgaagaactcattgagcaacatcaaaatcctaataagccaaaatatatggaaggagatattgttgatcttttgctacaattgaagaaagagaaattaacaccacttgatctcactatggaagatataaaaggaattctcatgaatgtgttagttgcaggatcagacactagtgcagctgctactgtttgggcaatgacagccttgataaagaatcctaaagccatggaaaaagttcaattagaaatcagaaaatcagttgggaagaaaggcattgtaaatgaagaagatgtccaaaacatcccttattttaaagcagtgataaaggaaatatttagattgtatccaccagctccacttttagttccaagagaatcaatggaaaaaaccatattagaaggttatgaaattcggccaagaaccatagttcatgttaacgcttgggctatagcaagggatcctgaaatatgggaaaatccagatgaatttatacctgagagatttttgaatagcagtatcgattacaagggtcaagattttgagttacttccatttggtgcaggcagaagaggttgcccaggtattgcacttggggttgcatccatggaacttgctttgtcaaatcttctttatgcatttgattgggagttgccttatggagtgaaaaaagaagacatcgacacaaacgttaggcctggaattgccatgcacaagaaaaacgaactttgccttgtcccaaaaaaattatttataaattatattgggacgtggatctcatgctagttctgtgcggtcagctaagctta

SEQ ID NO: 258 - protein, 223 aa, Nicotiana tabacum
MLFLLFVALPFILIFLLPKFKNGGNNRLPPGPIGLPFIGNLHQYDSITPHIYFWKLSKKYGKIFSLKLASTNVVVVSSAKLAKEVLKKQDLIFCSRPSILGQQKLSYYGRDIAFAPYNDYWREMRKICVLHLFSLKKVQLFSPIREDEVFRMIKKISKQASTSQIINLSNLMISLTSTIICRVAFGVRFEEEAHARKRFDFLLAEAQEMMASFFVSDFFPFLS

SEQ ID NO: 259 - DNA, 1615 bp, Nicotiana tabacum
cacattgagtcctctcccaaatcactgattcaccaccaaaagtaccaacaattcaatggaaggtacaaacttgactacatatgcagcagtatttcttgatactctgtttcttttgttcctttccaaacttcttcgccagaggaaactcaatttacctccaggcccaaaaccatggccgatcatcggaaacttaaaccttattggcaatcttcctcatcgctcaatccacgaactctccctcaagtacggacccgttatgcaactccaattcgggtctttccccgttgtagttggatcctccgtcgaaatggctaagattttcctcaaatccatggatattaactttgtaggcaggcctaaaacggctgccggaaaatacacaacgtacaattattccgatattacatggtctccttacggaccatattggcgccaggcacgtaggatgtgcctaacggaattattcagcacgaaacgtctcgattcatacgagtatattcgggctgaggagttgcattctcttctccataatttgaacaaaatatcagggaaaccaattgtgttgaaagattatttgacgacgttgagtttaaatgttattagcaggatggtactggggaaaaggtatttggacgaatccgagaactcgttcgtgaatcctgaggaatttaagaagatgttggacgaattgtttttgctaaatggtgtacttaatattggagattcaattccatggattgatttcatggatttgcaaggttatgttaagaggatgaaagtagtgagcaagaaattcgacaagtttttagagcatgttattgatgagcataacattaggagaaatggagtggagaattatgttgctaaggatatggtggatgttttgttgcagcttgctgatgatccgaagttggaagttaagctggagagacatggagtcaaagcattcactcaggatatgctggctggtggaaccgagagttcagcagtgacagtggagtgggcaatttcagagctgctaaagaagccggagattttcaaaaaggctacagaagaattggatcgagtaattgggcagaatagatgggtacaagaaaaggacattccaaatcttccttacatagaggcaatagtcaaagagactatgcgactgcaccccgtggcaccaatgttggtgccacgtgagtgtcgagaagatattaaggtagcaggctacgacgttcagaaaggaactagggttctcgtgagtgtatggactattggaagagaccctacattgtgggacgagcctgaggtgttcaagccggagagattccatgaaaagtccatagatgttaaaggacatgattatgagcttttgccatttggagcggggagaagaatgtgcccgggttatagcttggggctcaaggtgattcaagctagcttagctaatcttctacatggatttaactggtcattgcctgataatatgactcctgaggacctcaacatggatgagatttttgggctctctacacctaaaaaatttccacttgctactgtgattgagccaagactttcaccaaaactttactctgtttgattcagcagttctatggttccgtcaagatag

SEQ ID NO: 260 - protein, 509 aa, Nicotiana tabacum
MEGTNLTTYAAVFLDTLFLLFLSKLLRQRKLNLPPGPKPWPIIGNLNLIGNLPHRSIHELSLKYGPVMQLQFGSFPVVVGSSVEMAKIFLKSMDINFVGRPKTAAGKYTTYNYSDITWSPYGPYWRQARRMCLTELFSTKRLDSYEYIRAEELHSLLHNLNKISGKPIVLKDYLTTLSLNVISRMVLGKRYLDESENSFVNPEEFKKMLDELFLLNGVLNIGDSIPWIDFMDLQGYVKRMKVVSKKFDKFLEHVIDEHNIRRNGVENYVAKDMVDVLLQLADDPKLEVKLERHGVKAFTQDMLAGGTESSAVTVEWAISELLKKPEIFKKATEELDRVIGQNRWVQEKDIPNLPYIEAIVKETMRLHPVAPMLVPRECREDIKVAGYDVQKGTRVLVSVWTIGRDPTLWDEPEVFKPERFHEKSIDVKGHDYELLPFGAGRRMCPGYSLGLKVIQASLANLLHGFNWSLPDNMTPEDLNMDEIFGLSTPKKFPLATVIEPRLSPKLYSV

SEQ ID NO: 261 - DNA, 1610 bp, Nicotiana tabacum; identical to SEQ ID NO: 197

SEQ ID NO: 262 - protein, 503 aa, Nicotiana tabacum; identical to SEQ ID NO: 198

SEQ ID NO: 263 - DNA, 1611 bp, Nicotiana tabacum
ctttcatcatatggcatgaaatgggaaatgctcacaacagcaaaattgcagcaatctgtttgataattttcttggtatataaagcatgggaattgttgaagtggatatggattaagccaaagaaactggagagttgcctcagaaaacagggactcaaaggaaattcctacgggctattctatggagatatgaaagaattgtccaaaagtctcaaggaaatcaattcaaagcccatcatcaatctatcaaatgaagtagccccaagaatcattccttattatcttgaaatcatccaaaaatatggtaaaagatgttttgtttggcaaggaccaacccccgcaatattaataacagagccagaattaataaaggagatatttggtaagaactatgtttttcagaagcctaataatcccaacccactgaccaagttattggctcgaggtgttgtaagctacgaggaagaaaaatgggcaaaacacagaaagatcttaaatcctgcctttcatatggagaagttgaagcatatgctaccagcattttacttgagctgtagtgagatgctgaacaaatgggaggagattatcccagtaaaagaatcaaatgagttggacatttggcctcatcttcaaagaatgacaagtgatgtgatttctcgtgctgcctttggtagtagctacgaagaaggaagaagaatatttgaacttcaagaagaacaagctgagtatctaacgaagacattcaattcagtttatatcccaggttccagattttttcccaataaaatgaacaaaagaatgaaagaatgtgaaaaggaagtacgagaaacaattacgtgtctaattgacaacagattaaaggcaaaagaagaaggcaatggcaaggccctcaatgatgacctattgggtatattattagagtcaaattctatagaaattgaagaacatggtaacaagaagtttggaatgagtatacctgaagtaattgaagagtgcaaattattctattttgctggccaagagactacatcagtattgcttgtgtggacactgattttgttagggagaaatccagaatggcaggaacgtgctagagaggaagtttttcaagcctttggaagtgataaaccaacttttgacgaattatatcgcttgaaaattgtgacgatgattttgtacgagtctttaaggttatatccaccaatagcaactcgtactcgaaggactaatgaagaaacaaaattaggggaactagatttaccaaagggtgcactgctctttataccaacaatcttattacatcttgacagggaaatttggggtgaagatgcagatgagttcaatccggagagatttagcgaaggggtggcaaaggcaacaaaggggaaaatgacatattttccatttggtgcaggaccgcgaaaatgcattgggcaaaacttcgcgattttggaagcaaaaatggctatagctatgattctacaacgcttctccttcgagctctctccatcttatacacactctccatacactgtggtcactttgaaacccaaatatggtgctcccctaataatgcacaggctgtagtcctgtgagaatatgctatccgagg

SEQ ID NO: 264 - protein, 521 aa, Nicotiana tabacum
MGNAHNSKIAAICLIIFLVYKAWELLKWIWIKPKKLESCLRKQGLKGNSYGLFYGDMKELSKSLKEINSKPIINLSNEVAPRIIPYYLEIIQKYGKRCFVWQGPTPAILITEPELIKEIFGKNYVFQKPNNPNPLTKLLARGVVSYEEEKWAKHRKILNPAFHMEKLKHMLPAFYLSCSEMLNKWEEIIPVKESNELDIWPHLQRMTSDVISRAAFGSSYEEGRRIFELQEEQAEYLTKTFNSVYIPGSRFFPNKMNKRMKECEKEVRETITCLIDNRLKAKEEGNGKALNDDLLGILLESNSIEIEEHGNKKFGMSIPEVIEECKLFYFAGQETTSVLLVWTLILLGRNPEWQERAREEVFQAFGSDKPTFDELYRLKIVTMILYESLRLYPPIATRTRRTNEETKLGELDLPKGALLFIPTILLHLDREIWGEDADEFNPERFSEGVAKATKGKMTYFPFGAGPRKCIGQNFAILEAKMAIAMILQRFSFELSPSYTHSPYTVVTLKPKYGAPLIMHRL

SEQ ID NO: 265 - DNA, 1570 bp, Nicotiana tabacum
ctcattatccatcacctaaaatggagaattcttgggtttttctagccttggcagggctatctgcattagcttttctctgtaaaataatcacctgtcgaagaccggttaaccggaaaataccaccaggtccaaaaccatggcccatcattggcaatttgaacctacttggtcctataccacatcaatcttttgacttgctttccaaaaaatatggagagttgatgctgctgaaatttggctccaggccagttcttgttgcttcatctgctgaaatggcaaaacagtttttaaaagtacatgatgctaatttcgcctcccgtcctatgctagctggtggaaagtatacaagctataactattgtgacatgacatgggcaccctatggtccctattggcgccaagcacgacgaatttaccttaaccagatatttactccgaaaaggctagactcgttcgagtacattcgtgttgaagaaaggcaggccttgatttcccagctgaattcccttgctggaaagccattttttctcaaagaccatttgtcgcgatttagcctctgcagcatgacaaggatggttttgagcaacaagtattttggtgaatcaacagttagagtagaagatttgcagtacctggtagatcaatggttcttacttaatggtgctttcaacattggagattggattccatggctcagcttcttggacctacaaggctatgtgaaacaaatgaaggctttgaaaagaacttttgataagttccacaacattgtgctagatgatcacagggctaagaagaatgcagagaagaactttgtcccaaaagacatggttgatgtcttgttgaagatggctgaagatcctaatctggaagtcaaactcactaatgactgtgtcaaagggttaatgcaggatttactaactggaggaacagatagcttaacagcagcagtgcaatgggcatttcaagaacttcttagacagccaagggttattgagaaggcaaccgaagagcttgaccggattgtcgggaaagagagatgggtagaagagaaagattgctcgcagctatcttacgttgaagcaatcctcaaggaaacactaaggttacatcctctaggaactatgctagcaccgcattgtgctatagaagattgtaacgtggctggttatgacatacagaaaggaacgacctttctggtgaatgtttggaccattggaagggacccaaaatactgggatagagcacaagagtttctccccgagagatttttagagaacgacattgatatggacggacataactttgctttcttgccatttggctcggggcgaaggaggtgccctggctatagccttggacttaaggttatccgagtaacattagccaacatgttgcatggattcaactggaaattacctgaaggtatgaagccagaagatataagtgtggaagaacattatgggctcactacacatcctaagtttcctgttcctgtgatcttggaatctagactttcttcagatctctattcccccatcacttaatcctaagtgcttcctattatagc

SEQ ID NO: 266 - protein, 508 aa, Nicotiana tabacum
MENSWVFLALAGLSALAFLCKIITCRRPVNRKIPPGPKPWPIIGNLNLLGPIPHQSFDLLSKKYGELMLLKFGSRPVLVASSAEMAKQFLKVHDANFASRPMLAGGKYTSYNYCDMTWAPYGPYWRQARRIYLNQIFTPKRLDSFEYIRVEERQALISQLNSLAGKPFFLKDHLSRFSLCSMTRMVLSNKYFGESTVRVEDLQYLVDQWFLLNGAFNIGDWIPWLSFLDLQGYVKQMKALKRTFDKFHNIVLDDHRAKKNAEKNFVPKDMVDVLLKMAEDPNLEVKLTNDCVKGLMQDLLTGGTDSLTAAVQWAFQELLRQPRVIEKATEELDRIVGKERWVEEKDCSQLSYVEAILKETLRLHPLGTMLAPHCAIEDCNVAGYDIQKGTTFLVNVWTIGRDPKYWDRAQEFLPERFLENDIDMDGHNFAFLPFGSGRRRCPGYSLGLKVIRVTLANMLHGFNWKLPEGMKPEDISVEEHYGLTTHPKFPVPVILESRLSSDLYSPIT

SEQ ID NO: 267 - DNA, 1617 bp, Nicotiana tabacum
cacattgagtcctctcccaaatcactgattcaccaccaaaagtaccaacaattcaatggaaggtacaaacttgactacatatgcagcagtatttcttgatactctgtttcttttgttcctttccaaacttcttcgccagaggaaactcaatttacctccaggcccaaaaccatggccgatcatcggaaacttaaaccttattggcaatcttcctcatcgctcaatccacgaactctccctcaagtacggacccgttatgcaactccaattcgggtctttccccgttgtagttggatcctccgtcgaaatggctaagattttcctcaaatccatggatattaactttgtaggcaggcctaaaacggctgccggaaaatacacaacgtacaattattccgatattacatggtctccttacggaccatattggcgccaggcacgtaggatgtgcctaacggaattattcagcacgaaacgtctcgattcatacgagtatattcgggctgaggagttgcattctcttctccataatttgaacaaaatatcagggaaaccaattgtgttgaaagattatttgacgacgttgagtttaaatgttattagcaggatggtactggggaaaaggtatttggacgaatccgagaactcgttcgtgaatcctgaggaatttaagaagatgttggacgaattgtttttgctaaatggtgtacttaatattggagattcaattccatggattgatttcatggatttgcaaggttatgttaagaggatgaaagtagtgagcaagaaattcgacaagtttttagagcatgttattgatgagcataacattaggagaaatggagtggagaattatgttgctaaggatatggtggatgttttgttgcagcttgctgatgatccgaagttggaagttaagctggagagacatggagtcaaagcattcactcaggatatgctggctggtggaaccgagagttcagcagtgacagtggagtgggcaatttcagagctgctaaagaagccggagattttcaaaaaggctacagaagaattggatcgagtaattgggcagaatagatgggtacaagaaaaggacattccaaatcatccttacatagaggcaatagtcaaagagactatgcgactgcaccccgtggcaccaatgttggtgccacgtgagtgtcgagaagatattaaggtagcaggctacgacgttcagaaaggaactagggttctcgtgagtgtatggactattggaagagaccctacattgtgggacgagcctgaggtgttcaagccggagagattccatgaaaagtccatagatgttaaaggacatgattatgagcttttgccatttggagcggggagaagaatgtgcccgggttatagcttggggctcaaggtgattcaagctagcttagctaatcttctacatggatttaactggtcattgcctgataatatgactcctgaggacctcaacatggatgagatttttgggctctctacacctaaaaaatttccacttgctactgtgattgagccaagactttcaccaaaactttactctgtttgattcagcagttctatggatccgtcaagatagac

SEQ ID NO: 268 - protein, 509 aa, Nicotiana tabacum
MEGTNLTTYAAVFLDTLFLLFLSKLLRQRKLNLPPGPKPWPIIGNLNLIGNLPHRSIHELSLKYGPVMQLQFGSFPVVVGSSVEMAKIFLKSMDINFVGRPKTAAGKYTTYNYSDITWSPYGPYWRQARRMCLTELFSTKRLDSYEYIRAEELHSLLHNLNKISGKPIVLKDYLTTLSLNVISRMVLGKRYLDESENSFVNPEEFKKMLDELFLLNGVLNIGDSIPWIDFMDLQGYVKRMKVVSKKFDKFLEHVIDEHNIRRNGVENYVAKDMVDVLLQLADDPKLEVKLERHGVKAFTQDMLAGGTESSAVTVEWAISELLKKPEIFKKATEELDRVIGQNRWVQEKDIPNHPYIEAIVKETMRLHPVAPMLVPRECREDIKVAGYDVQKGTRVLVSVWTIGRDPTLWDEPEVFKPERFHEKSIDVKGHDYELLPFGAGRRMCPGYSLGLKVIQASLANLLHGFNWSLPDNMTPEDLNMDEIFGLSTPKKFPLATVIEPRLSPKLYSV

SEQ ID NO: 269 - DNA, 1657 bp, Nicotiana tabacum
tgcaatatagttttcctagtcagttctagcctccttttccttagaaataatggattatcatatttctttccattttcaagctcttttagggcttttagcctttgtgttcttgtctattatcttatggagaagaacactcacttcaagaaaattagcccctgaaatcccaggggcatggcctattataggccatcttcgtcagctgagtggtactgataagaatatcccatttccccgaatattgggcgctttggcagataaatatggacctgtcttcacactgagaatagggatgtacccctatttgattgtcaacaattgggaagcagctaaggattgtctcacaacgcatgataaggacttcgctgcccgaccaacttctatggctggtgaaagcatcgggtacaagtatgcgaggtttacttatgctaattttggtccttattataaccaagtgcgcaaactagccctacaacatgtactctcgagtactaaactcgagaaaatgaaacacatacgtgtttctgaattggaaactagcatcaaagaattatattctttgacgctgggcaaaaacaacatgcaaaaagtgaatataagtaaatggtttgaacaattgactttaaacataatcgtgaagacaatttgtggcaagagatatagcaacatagaggaggatgaagaggcacaacgtttcagaaaggcatttaagggcatcatgtttgttgtagggcaaattgttttatatgacgcaattccattcccattgttcaaatactttgatttccaaggtcatatacaattgatgaacaaaatttataaagacttagattctattcttcaaggatggttggatgatcatatgatgaacaaggatgtaaacaataaggatcaagatgccatagatgccatgcttaaggtaacacaacttaatgaattcaaagcctatggtttttctcaggccactgtgatcaagtcgacagtcttgagtttgatcttagatggaaatgacacaaccgctgttcatttgatatgggtaatgtccttattactgaacaatccacatgttatgaaacaaggccaagaagagatagacatgaaagtgggtaaagagaggtggattgaagatactgacataaaaaatttagtgtaccttcaggctatcgttaaagagacattgcgcttgtatccacctgttccttttcttttaccacacgaagcagtgcaagattgtaaagtgactggttaccacattcctaaaggtactcgtctatatatcaatgcgtggaaagtacatcgcgattctgaaatttggtcagagcccgaaaagtttatgcccaatagattcttgactagcaaagcaaatatagatgctcgcggtcaaaattttgaatttataccgtttggttctgggagacggtcatgtccagggttaggttttgcgactttagtgacacatctgacttttggtcgcttgcttcaaggttttgattttagtaagccatcaaacacgccaattgacatgacagaaggcgtaggcgttactttgcctaaggttaatcaagttgaagttctaattacccctcgtttaccttctaagctttatttattttgaaagtgcaaatcatcaatcatgggttgagtaattagtgatact

SEQ ID NO: 270 - protein, 521 aa, Nicotiana tabacum
MDYHISFHFQALLGLLAFVFLSIILWRRTLTSRKLAPEIPGAWPIIGHLRQLSGTDKNIPFPRILGALADKYGPVFTLRIGMYPYLIVNNWEAAKDCLTTHDKDFAARPTSMAGESIGYKYARFTYANFGPYYNQVRKLALQHVLSSTKLEKMKHIRVSELETSIKELYSLTLGKNNMQKVNISKWFEQLTLNIIVKTICGKRYSNIEEDEEAQRFRKAFKGIMFVVGQIVLYDAIPFPLFKYFDFQGHIQLMNKIYKDLDSILQGWLDDHMMNKDVNNKDQDAIDAMLKVTQLNEFKAYGFSQATVIKSTVLSLILDGNDTTAVHLIWVMSLLLNNPHVMKQGQEEIDMKVGKERWIEDTDIKNLVYLQAIVKETLRLYPPVPFLLPHEAVQDCKVTGYHIPKGTRLYINAWKVHRDSEIWSEPEKFMPNRFLTSKANIDARGQNFEFIPFGSGRRSCPGLGFATLVTHLTFGRLLQGFDFSKPSNTPIDMTEGVGVTLPKVNQVEVLITPRLPSKLYLF

SEQ ID NO: 271 - DNA, 1620 bp, Nicotiana tabacum
agagagtgaaaatggacgcactacttcaaatgacagtaacagcatcttgtgctgccatagtaattactctgctggtgtgtatatggagagtgctgaactggatttggttcagaccaaagaaattggagttgttgttgagaaaacaaggtttggaaggaaattcttacaaggttttgtatggggacatgaaagagttttctgggatgattaaggaagcatactcaaagcctatgagtctatctgatgatgtagcaccaagactgatgcctttctttcttgaaaccatcaaaaaatatggaaaaagatcctttatatggtttggtccaagaccactagtattgattatggatcctgagcttataaaggaagtactctcaaaaatccatctgtatcaaaagcctggtggaaatccattagcaacactattggtacaaggaatagcaacctatgaggaagacaaatgggccaaacatagaaaaatcatcaatcccgctttccatctagagaagctaaagcttatgcttccagcatttcgcttaagctgtagtgagatgctgagcaaatgggaagacattgtttcagctgatagctcacatgagatagatgtatggtctcaccttgagcaattgacttgcgatgtgatctctcggacagcttttggcagtagttatgaagaaggtagaaagatttttgaacttcaaaaggaacaagctcagtatcttgtggaagttttccgctccgtttatatcccaggaaggagatttttgccaacaaagaggaatagaagaatgaaggaaataaaaaaggatgtccgggcatcaattaaaggtattattgataaaagattgaaggcaatgaaagcaggggacaccaataatgaggatctattgggtatattactggaatcgaatattaaagaaattgaacagcacggaaacaaggattttggaatgagcattgaagaagtcattgaagaatgcaagttattctattttgctggccaagaaactacatcagtgttactcctatggtctctagtgttgttgagcaggtatcaagattggcaggcacgggccagagaagaaatcttgcaagtctttggcagtcgaaaaccagattttgacggattaaatcatctaaaaattgtgacaatgatcttgtacgagtctttaaggctgtatccctcactaataacacttacccgccggtgtaatgaagacattgtattaggagaactatctctaccagctggtgttctagtctctttgccattgattttgttgcatcatgatgaagagatatggggtgaagatgcaaaggagttcaaaccagagagatttagagaaggaatatcaagtgcaacaaagggtcaactcacatattttccatttagctggggtcctagaatatgtattggacaaaattttgccatgttagaagcaaagatggctctgtctatgatcctgcaacgcttctcttttgaactgtctccgtcttatgcacatgcccctcggtccataataaccgttcagcctcagtatggtgctccacttattttccacaaactataattttggtacttctactaatattttagggtttattcagactcaaaaaaaa

SEQ ID NO: 272 - protein, 513 aa, Nicotiana tabacum
MTVTASCAAIVITLLVCIWRVLNWIWFRPKKLELLLRKQGLEGNSYKVLYGDMKEFSGMIKEAYSKPMSLSDDVAPRLMPFFLETIKKYGKRSFIWFGPRPLVLIMDPELIKEVLSKIHLYQKPGGNPLATLLVQGIATYEEDKWAKHRKIINPAFHLEKLKLMLPAFRLSCSEMLSKWEDIVSADSSHEIDVWSHLEQLTCDVISRTAFGSSYEEGRKIFELQKEQAQYLVEVFRSVYIPGRRFLPTKRNRRMKEIKKDVRASIKGIIDKRLKAMKAGDTNNEDLLGILLESNIKEIEQHGNKDFGMSIEEVIEECKLFYFAGQETTSVLLLWSLVLLSRYQDWQARAREEILQVFGSRKPDFDGLNHLKIVTMILYESLRLYPSLITLTRRCNEDIVLGELSLPAGVLVSLPLILLHHDEEIWGEDAKEFKPERFREGISSATKGQLTYFPFSWGPRICIGQNFAMLEAKMALSMILQRFSFELSPSYAHAPRSIITVQPQYGAPLIFHKL

SEQ ID NO: 273 - DNA, 1671 bp, Nicotiana tabacum
tgcaatatagttttcctagtcagttctagcctccttttccttagaaataatggattatcatatttctttccattttcaagctcttttagggcttttagcctttgtgttcttgtctattatcttatggagaagaacactcacttcaagaaaattagcccctgaaatcccaggggcatggcctattataggccatcttcgtcagctgagtggtactgataagaatatcccatttccccgaatattgggcgctttggcagataaatatggacctgtcttcacactgagaatagggatgtacccctatttgattgtcaacaattgggaagcagctaaggattgtctcacaacgcatgataaggacttggctgcccgaccaacttctatggctggtgaaagcatcgggtacaagtatgcgaggtttacttatgctaattttggtccttattataaccaagtgcgcaaactagccctacaacatgtactctcgagtactaaactcgagaaaatgaaacacatacgtgtttctgaattggaaactagcatcaaagaattatattctttgacgctgggcaaaaacaacatgcaaaaagtgaatataagtaaatggtttgaacaattgactttaaacataatcgtgaagacaatttgtggcaagagatatagcaacatagaggaggatgaagaggcacaacgtttcagaaaggcatttaagggcatcatgtttgttgtagggcaaattgttttatatgacgcaattccattcccattgttcaaatactttgatttccaaggtcatatacaattgatgaacaaaatttataaagacttagattctattcttcaaggatggttggatgatcatatgatgaacaaggatgtaaacaataaggatcaagatgccatagatgccatgcttaaggtaacacaacttaatgaattcaaagcctatggtttttctcaggccactgtgatcaagtcgacagtcttgagtttgatcttagatggaaatgacacaaccgctgttcatttgatatgggtaatgtccttattactgaacaatccacatgttatgaaacaaggccaagaagagatagacatgaaagtgggtaaagagaggtggattgaagatactgacataaaaaatttagtgtaccttcaggctatcgttaaagagacattgcgcttgtatccacctgttccttttcttttaccacacgaagcagtgcaagattgtaaagtgactggttaccacattcctaaaggtactcgtctatatatcaatgcgtggaaagtacatcgcgatcctgaaatttggtcagagcccgaaaagtttatgcccaatagattcttgactagcaaagcaaatatagatgctcgcggtcaaaattttgaatttataccgtttggttctgggagacggtcatgtccagggataggttttgcgactttagtgacacatctgacttttggtcgcttgcttcaaggttttgattttagtaagccatcaaacacgccaattgacatgacagaaggcgtaggcgttactttgcctaaggttaatcaagttgaagttctaattacccctcgtttaccttctaagctttatttattttgaaggtgcaaatcatcaatcatggcttgagtaattagttatactttaatatgtttctc

SEQ ID NO: 274 - protein, 521 aa, Nicotiana tabacum
MDYHISFHFQALLGLLAFVFLSIILWRRTLTSRKLAPEIPGAWPIIGHLRQLSGTDKNIPFPRILGALADKYGPVFTLRIGMYPYLIVNNWEAAKDCLTTHDKDLAARPTSMAGESIGYKYARFTYANFGPYYNQVRKLALQHVLSSTKLEKMKHIRVSELETSIKELYSLTLGKNNMQKVNISKWFEQLTLNIIVKTICGKRYSNIEEDEEAQRFRKAFKGIMFVVGQIVLYDAIPFPLFKYFDFQGHIQLMNKIYKDLDSILQGWLDDHMMNKDVNNKDQDAIDAMLKVTQLNEFKAYGFSQATVIKSTVLSLILDGNDTTAVHLIWVMSLLLNNPHVMKQGQEEIDMKVGKERWIEDTDIKNLVYLQAIVKETLRLYPPVPFLLPHEAVQDCKVTGYHIPKGTRLYINAWKVHRDPEIWSEPEKFMPNRFLTSKANIDARGQNFEFIPFGSGRRSCPGIGFATLVTHLTFGRLLQGFDFSKPSNTPIDMTEGVGVTLPKVNQVEVLITPRLPSKLYLF

SEQ ID NO: 275 - DNA, 1618 bp, Nicotiana tabacum
tttgattcaaccatggagaaccaatactcctactcattctcttcctacttctacttagctatagtactgtttcttcttccaattttggtcaaatatttcttccatcggagaagaaatttacctccaagtccattttctcttccaataattggtcacctttaccttctcaagaaaactctccatctcactctaacatccttatcagctaaatatggtcctgttttatacctcaaattgggctctatgcctgtgattgttgtgtcctcaccatctgctgttgaagaatgtttaaccaagaatgatatcatattcgcaaataggcccaagaccgtggctggtgacaagtttacctacaattatactgtttatgtttgggcaccctatggccaactttggagaattcttcgccgattaactgtcgttgaactcttctcttcacatagcctacagaaaacttctatccttagagatcaagaagttgcaatatttatccgttcgttatacaaattctcaaaggatagtagcaaaaaagtcgatttgaccaactggtcttttactttggttttcaatcttatgaccaaaattattgctgggagacatattgtgaaggaggaagatgctggcaaggaaaagggcattgaaattattgaaaaacttagagggactttcttagtaactacatcattcttgaatatgtgtgatttcttgccagtattcaggtgggttggttacaaagggcaggagaagaagatggcctcaattcacaatagaagaaatgaattcttgaacagcttgcttgatgaatttcgacacaagaaaagtagtgcttcacaatctaacacaactgttggaaacatggagaagaaaaccacactgattgaaaagctcttgtctcttcaagaatcagagcctgaattctacactgatgatatcatcaaaagtattatgctggtagtttttgttgcaggaacagagacctcatcaacaaccatccaatgggtaatgaggcttcttgtagctcaccctgaggcattgtataagctacgagctgacattgacagtaaagttgggaataagcgcttgctgaatgaatcagacctcaacaagcttccgtatttgcattgtgttgttaatgagacaatgagattatacactccgataccacttttattgcctcattattcaactaaagattgtattgtggaaggatatgatgtaccaaaacatacaatgttgtttgtcaacgcttgggccattcacagggatcccaaggtatgggaggagcctgacaagttcaagccagagagatttgaggcaacagaaggggaaacagaaaggttcaattacaagcttgtaccatttggaatggggagaagagcgtgccctggagctgatatggggttgcgagcagtttctttggcattaggtgcacttattcaatgctttgactggcaaattgaggaagcggaaagcttggaggaaagctataattctagaatgactatgcagaacaagcctttgaaggttgtctgcactccacgcgaagatcttggccagcttctatcccaactctaaggcaatttatcaatgccaaacgtaatcttcatctaccactatg

SEQ ID NO: 276 - protein, 520 aa, Nicotiana tabacum
MENQYSYSFSSYFYLAIVLFLLPILVKYFFHRRRNLPPSPFSLPIIGHLYLLKKTLHLTLTSLSAKYGPVLYLKLGSMPVIVVSSPSAVEECLTKNDIIFANRPKTVAGDKFTYNYTVYVWAPYGQLWRILRRLTVVELFSSHSLQKTSILRDQEVAIFIRSLYKFSKDSSKKVDLTNWSFTLVFNLMTKIIAGRHIVKEEDAGKEKGIEIIEKLRGTFLVTTSFLNMCDFLPVFRWVGYKGQEKKMASIHNRRNEFLNSLLDEFRHKKSSASQSNTTVGNMEKKTTLIEKLLSLQESEPEFYTDDIIKSIMLVVFVAGTETSSTTIQWVMRLLVAHPEALYKLRADIDSKVGNKRLLNESDLNKLPYLHCVVNETMRLYTPIPLLLPHYSTKDCIVEGYDVPKHTMLFVNAWAIHRDPKVWEEPDKFKPERFEATEGETERFNYKLVPFGMGRRACPGADMGLRAVSLALGALIQCFDWQIEEAESLEESYNSRMTMQNKPLKVVCTPREDLGQLLSQL

SEQ ID NO: 277 - DNA, 1676 bp, Nicotiana tabacum
cctttttaagatgtatttaagatttaagatttaagatgaagcaactgaggtaagtcctttcaaggagtagttgtcacttctgagaatggagatgatgtacagcataatagcagcagccagtattgcaattatcttggtatatacatggaaagtgttgaattgggcttggtttgggccgaagaaaatggagaaatgcttaagacagaggggtctcaagggaaatccttataagctactctatggagatctaaacgaactgacaaaaagcataatagaagccaagtctaagcccatcaatttctctgatgatattgctcaaaggctcatccctttttttcttgacgccatcaacaaaaatggtaaaaactccttcgtctggcttggaccgtatccaatagtgttgatcacggatcctgagcatttaaaggagattttcacaaagaattatgtgtatcaaaagcaaactcatcccaatccatacgccaagctattagctcacggtcttgtcagccttgaggaagacaaatgggccaaacacagaaaaatcattagtcctgccttccatgtcgagaagctaaagcatatgctgcctgcattttatctgagttgtagtgaaatgataagcaaatgggaggaggttgttccaaaagaaacatcattcgagctcgatgtatggccagaccttcaaataatgaccagtgaagtcatttctcgcactgcatttgggagtagctatgaagaaggaagaatagtatttgaacttcagaaagaacaagctgagtatgtaatggacataggacgttcaatttatataccaggatcaaggttcttgcctactaaaaggaacaaaagaatgctggaaattgaaaagcaagtgcaaacaacaattaggcgtatcatcgacaaaagattgaaggcaatggaagaaggggagactagtaaagatgacttattaggcatattacttgaatccaatttgaaagaaattgaacttcatggaagaaatgacttgggaataacaacgtcagaagtgattgaagagtgcaagttattctattttgccggccaagagaccacttcagtgttgcttgtttggacaatgattttgttgtgcttacatccagagtggcaagtacgtgccagaaaggaagtgttgcagatctttggaaatgataaaccagatttggaaggactaagtcgcttgaaaattgtaacaatgatcttgtacgagacgttacgcctattccccccattaccagcatttggtagaaggaacaaagaagaagtcaaattaggggagctacatctaccggctggagtgttactcgttataccagcaatcttagtacattatgataaggaaatatggggtgaagatgcaaaggaattcaaaccagaaagattcagtgaaggagtgtcaaaggcaacaaatggacaagtctcatttataccatttagctggggacctcgtgtttgcattggacaaaacttcgcaatgatggaagcaaaaatggcagtaactatgatactacaaaaattctcctttgaactatccccttcttatacacatgctccatttgcaattgtgactattcatccccagtatggtgctcctctgcttatgcgcagactttaaaacatatgttgctgatatttaagatcagtggcgttttatt

SEQ ID NO: 278 - protein, 516 aa, Nicotiana tabacum
MEMMYSIIAAASIAIILVYTWKVLNWAWFGPKKMEKCLRQRGLKGNPYKLLYGDLNELTKSIIEAKSKPINFSDDIAQRLIPFFLDAINKNGKNSFVWLGPYPIVLITDPEHLKEIFTKNYVYQKQTHPNPYAKLLAHGLVSLEEDKWAKHRKIISPAFHVEKLKHMLPAFYLSCSEMISKWEEVVPKETSFELDVWPDLQIMTSEVISRTAFGSSYEEGRIVFELQKEQAEYVMDIGRSIYIPGSRFLPTKRNKRMLEIEKQVQTTIRRIIDKRLKAMEEGETSKDDLLGILLESNLKEIELHGRNDLGITTSEVIEECKLFYFAGQETTSVLLVWTMILLCLHPEWQVRARKEVLQIFGNDKPDLEGLSRLKIVTMILYETLRLFPPLPAFGRRNKEEVKLGELHLPAGVLLVIPAILVHYDKEIWGEDAKEFKPERFSEGVSKATNGQVSFIPFSWGPRVCIGQNFAMMEAKMAVTMILQKFSFELSPSYTHAPFAIVTIHPQYGAPLLMRRL

SEQ ID NO: 279 - DNA, 1577 bp, Nicotiana tabacum
ctaaatttcatatacctttagtactcttgaaattttcaaataatggtttatcttctttctcccatagaagccattgtaggatttgtaaccttttcatttctattctactttctatggaccaaaaaacaatcaaaaatcttaaacccactacctccaaaaatcccaggtggatggccagtaatcggccatctcttttatttcaagaacaatggcgatgaagatcgccatttttctcaaaaactcggtgacttagctgacaaatatggtcccgtcttcactttccggttagggtttcgccgtttcttggcggtgagtagttatgaagctatgaaagaatgcttcactaccaatgatatccatttcgccgatcggccatctttactctacggagaatacctttgctataataatgccatgcttgctgttgccaaatatggcccttactggaaaaaaaatcgaaagttagtcaatcaagaagttctctccgttagtcggctcgaaaaattcaaacatgttagattttctataattcagaaaaatattaaacaattgtataattgtgattcaccaatggtgaagataaaccttagtgattggatagataaattgacattcgacatcattttgaaaatggttgttgggaagaactataataatggacatggagaaatactcaaagttgcttttcagaaattcatggttcaagctatggagatggagctctatgatgtttttcacattccatttttcaagtggttggatcttacagggaatattaaggctatgaaacaaactttcaaagacattgataatattatccaaggttggttagatgagcacattaagaagagagaaacaaaggatgttggaggtgaaaacgaacaagattttatagatgtggtgctttccaagatgagcgacgaacatcttggcgagggttactctcatgacacaaccatcaaagcaactgtattcactttggtcttggatgcaacagacacacttgcacttcatataaagtgggtaatggcgttaatgataaacaataagcatgtcatgaagaaagcacaagaagagatggacacaattgttggtagagatagatgggtagaagagagtgatatcaagaatttggtgtatctccaagcaattgttaaagaagtattacgattacatccacctgcacctttgtcagtgcaacacctatctgtggaagattgtgttgtcaatgggtaccatattcctaaggggactgcactacttaccaatattatgaaactacagcgagatcctcaaacatggccaaatcctgataaattcgatccagagagattcctgacgactcatgctactattgactaccgcgggcagcactatgagttgatcccctttggtacggggagacgagcttgtcccgcgatgaattattcattgcaagtggaacacctttcaattgctcatatgatccaaggtttcagttttgcaactacgaccaatgagcctttggatatgaaacaaggtgtgggtttaactttaccaaagaagactgatgttgaagttctaattacccctcgttt

SEQ ID NO: 280 - protein, 511 aa, Nicotiana tabacum
MVYLLSPIEAIVGFVTFSFLFYFLWTKKQSKILNPLPPKIPGGWPVIGHLFYFKNNGDEDRHFSQKLGDLADKYGPVFTFRLGFRRFLAVSSYEAMKECFTTNDIHFADRPSLLYGEYLCYNNAMLAVAKYGPYWKKNRKLVNQEVLSVSRLEKFKHVRFSIIQKNIKQLYNCDSPMVKINLSDWIDKLTFDIILKMVVGKNYNNGHGEILKVAFQKFMVQAMEMELYDVFHIPFFKWLDLTGNIKAMKQTFKDIDNIIQGWLDEHIKKRETKDVGGENEQDFIDVVLSKMSDEHLGEGYSHDTTIKATVFTLVLDATDTLALHIKWVMALMINNKHVMKKAQEEMDTIVGRDRWVEESDIKNLVYLQAIVKEVLRLHPPAPLSVQHLSVEDCVVNGYHIPKGTALLTNIMKLQRDPQTWPNPDKFDPERFLTTHATIDYRGQHYELIPFGTGRRACPAMNYSLQVEHLSIAHMIQGFSFATTTNEPLDMKQGVGLTLPKKTDVEVLITPR

SEQ ID NO: 281 - DNA, 1434 bp, Nicotiana tabacum
  misc_feature (564)..(564): n is a, c, g, or t
ctttttctccccaaaaaagagctcatttcccttgtccccaaaaatggatcttctcttactagagaagaccttaattggtctcttctttgccattttaatcgctgtaattgtctctagacttcgttcaaagcgttttaagcttcccccaggaccaatcccagtaccagtttttggtaattggcttcaagttggtgatgatttaaaccacagaaatcttactgattttgccaaaaaatttggtgatcttttcttgttaagaatgggccagcgtaatttagttgttgtgtcatctcctgaattagctaaagaagttttacacacacaaggtgttgaatttggttcaagaacaagaaatgttgtatttgatatttttactggaaaaggtcaagatatggtttttactgtatatggtgaacactggagaaaaatgaggagaattatgactgtaccattttttactaataaagttgtgcagcaatatagaggggggtgggagtttgaagtggcaagtgtaattgaggatgtgaagaaaaatcctgaatctgctactaatgggattgtatnaaggaggagattacaattgatgatgtataataatatgtttaggattatgtttgataggagatttgagagtgaagatgatcctttgtttgttaagcttaaggctttgaatggtgaaaggagtagattggctcagagttttgagtataattatggtgattttattcccattttgaggccttttttgagaggttatttgaagatctgtaaagaagttaaggagaagaggctgcagcttttcaaagattactttgttgatgaaagaaagaagctttcaaataccaagagcttggacagcaatgctctgaaatgtgcgattgatcacattcttgaggctcaacagaagggggagatcaatgaggacaacgttctttacattgttgaaaacatcaatgttgctgctatagaaaccacattatggtcaattgagtggggtatcgccgagttagtcaaccaccctcacatccaaaagaaactccgcgacgagattgacacagttcttggcccaggagtgcaagtgactgaaccagacacccacaagcttccataccttcaggctgtgatcaaggagacgcttcgtctccgtatggcaattcctctattagtcccacacatgaaccttcacgatgcaaagcttggcgggtttgatattccagcagagagcaaaatcttggttaacgcttggtggctagctaacaacccggctcattggaagaaacccgaagagttcagacccgagaggttcttcgaagaggagaagcacgttgaggccaatggcaatgacttcagatatcttccgtttggcgttggtaggaggagttgccctggaactatacttgcattgccaattcttggcattactttgggacgttt

SEQ ID NO: 282 - protein, 463 aa, Nicotiana tabacum
MDLLLLEKTLIGLFFAILIAVIVSRLRSKRFKLPPGPIPVPVFGNWLQVGDDLNHRNLTDFAKKFGDLFLLRMGQRNLVVVSSPELAKEVLHTQGVEFGSRTRNVVFDIFTGKGQDMVFTVYGEHWRKMRRIMTVPFFTNKVVQQYRGGWEFEVASVIEDVKKNPESATNGIVLRRRLQLMMYNNMFRIMFDRRFESEDDPLFVKLKALNGERSRLAQSFEYNYGDFIPILRPFLRGYLKICKEVKEKRLQLFKDYFVDERKKLSNTKSLDSNALKCAIDHILEAQQKGEINEDNVLYIVENINVAAIETTLWSIEWGIAELVNHPHIQKKLRDEIDTVLGPGVQVTEPDTHKLPYLQAVIKETLRLRMAIPLLVPHMNLHDAKLGGFDIPAESKILVNAWWLANNPAHWKKPEEFRPERFFEEEKHVEANGNDFRYLPFGVGRRSCPGTILALPILGITLGR

SEQ ID NO: 283 - DNA, 1723 bp, Nicotiana tabacum
ccaaattagagcaagaaattaacaagtctagttaccttctccctttttaagagtatttaagatttaagatttaagatgaagcaactgaggtaagtcctttcaaggagtagttgtcacttctgagaatggagatgatgtacagcataatagcagcagccagtattgcaattatcttggtatatacatggaaagtgttgaattgggcttggtttgggccaaagaaaatggagaaatgcttaagacagaggggtctcaagggaaatccttataagctactctatggagatctaaacgaactgacaaaaagcataatagaagccaagtctaagcccatcaatttctctgatgatattgctcaaaggctcatccctttttttcttgacgccatcaacaaaaatggtaaaaactccttcgtctggcttggaccgtatccaatagtgttgatcacggatcctgagcatttaaaggagattttcacaaagaattatgtgtatcaaaagcaaactcatcccaatccatacgccaagctattagctcacggtcttgtcagccttgaggaagacaaatgggccaaacacagaaaaatcattagtcctgccttccatgtcgagaagctaaagcatatgctgcctgcattttatctgagttgtagtgaaatgataagcaaatgggaggaggttgttccaaaagaaacatcattcgagctcgatgtatggccagaccttcaaataatgaccagtgaagtcatttctcgcactgcatttgggagtagctatgaagaaggaagaatagtatttgaacttcagaaagaacaagctgagtatgtaatggacataggacgttcaatttatataccaggatcaaggttcttgcctactaaaaggaacaaaagaatgctggaaattgaaaagcaagtgcaaacaacaattaggcgtatcatcgacaaaagattgaaggcaatggaagaaggggagactagtaaagatgacttattaggcatattacttgaatccaatttgaaagaaattgaacttcatggaagaaatgacttgggaataacaacatcagaagtgattgaagagtgcaagttaatctattttgccggccaagagaccacttcagtgttgcttgtttggacaatgattttgttgtgcttacatccagagtggcaagtacgtgccagaaaggaagtgttgcagacctttggaaatgataaaccagatttggaaggactaagtcgcttgaaaattgtaacaatgatcttgtacgagacgttacgcctattccccccattaccagcatttggtagaaggaacaaagaagaagtcaaattaggggagctacatctaccggctggagtgttactcgttataccagcaatcttagtacattatgataaggaaatatggggtgaagatgcaaaggaattcaaaccagaaagattcagtgaaggagtgtcaaaggcaacaaatggacaagtctcatttataccatttagctagggacctcgtgtttgcattggacaaaacttcgcaatgatggaagcaaaaatggcagtaactatgatactacaaaaattctcctttgaactatccccttcttatacacatgctccatttgcaattgtgactattcatccccagtatggtgctcctctgcttatgcgcagactttaaaacatatgttgctgatatttaagatcagtggcgttttattctccatg

SEQ ID NO: 284 - protein, 458 aa, Nicotiana tabacum
MEMMYSIIAAASIAIILVYTWKVLNWAWFGPKKMEKCLRQRGLKGNPYKLLYGDLNELTKSIIEAKSKPINFSDDIAQRLIPFFLDAINKNGKNSFVWLGPYPIVLITDPEHLKEIFTKNYVYQKQTHPNPYAKLLAHGLVSLEEDKWAKHRKIISPAFHVEKLKHMLPAFYLSCSEMISKWEEVVPKETSFELDVWPDLQIMTSEVISRTAFGSSYEEGRIVFELQKEQAEYVMDIGRSIYIPGSRFLPTKRNKRMLEIEKQVQTTIRRIIDKRLKAMEEGETSKDDLLGILLESNLKEIELHGRNDLGITTSEVIEECKLIYFAGQETTSVLLVWTMILLCLHPEWQVRARKEVLQTFGNDKPDLEGLSRLKIVTMILYETLRLFPPLPAFGRRNKEEVKLGELHLPAGVLLVIPAILVHYDKEIWGEDAKEFKPERFSEGVSKATNGQVSFIPFS

SEQ ID NO: 285 - DNA, 1717 bp, Nicotiana tabacum
tttgcctttgctcgtcattgatgacgacttcattttgttttcttccccacgaaaatggtagatatgatatggagggacgtagggaagaattactgggacaaacctagtgagtgaaaatggaaacagttgaaatgatagtaaaagtatcttgtgctgccatagtaattactctgttggtgtgtctatggagagtgctgaattgggtttggttcagaccaaagaaattagagaagttgttgagaaaacaggttttgtatggggacatgaaagagttttctgggatgattaaggaagcatactcaaagcctatgagtctgtctgatgatgtagcaccacgaatgatgcctttctttcttgaaaccatcaagaaatatggaaaaagatcctttatatggttcggtccaagaccactagtattgatcatggatcctgagcttataaaggaagtactctccaaaatctatctttatcaaaagcccggtggaaatccattagcaacactattggtacaaggattagcaacctatgaggaagacaaatgggccaaacatagaaaaatcatcaatcccgctttccatctagagaagctaaagcatatgcttccagcttttcgcttgagctgtagtgagatgctgagcaaatgggaagacattgtttcagctgaaggctcacatgagatagatgtatggcctaaccttgagcaattgagttgcgatgtgatctctcggacagcttttggcaatagttatgaagaaggtagaaagatttttgaacttcaaaaggaacaaactcagcatcttgtggaagctttccgctctgtttatatcccaggaaggagatttttgccaacaaagaggaatagaagaatgaaggaaataaaaaaggaggttcgagcgtcaattaaaggtattattgataaaagattgaaggcaatgaaagcaggggacaccaataatgaggatctattgggatattgctggaatcaaattttaaagaaattgaacagcgcggaaacaaggattttggaatgagcattgaagatgtcattgaagaatgcaagttattctattttgctggccaagaaactacatcagtgttgctcctatggtctctagtgtcgttgagcaggtatcaagattggcagacacgggccagagaagaagtcttgcatgtctttgggagtcggaaaccagattttgatgaattaaatcatctaaaagttgtgacaatgatcatgtacgagtctttaaggctatatccctcactaataacacttacccgccggtgtaatgaagacattgtattaggagaactatctctaccagctggtgtcctagtctctttgccaatgattttgttgcatcatgatgaagagatatggggtgaagatgcaaaggagttcaaaccagagagatttagagaaggattgtcaagtgcaacaaagggtcaacttacatattttccatttggctggggtcctagaatatgtattggacaaaattttgccatgttagaagcaaagatggctctgtctatgatcctgcaacgcttctcttttgaactgtctccgtcttatgcacatgcccctcagtccatattaaccgttcagcctcaatatggtgctccacttattttccacaagctataatttggtacttgtgaaaggtgtcttgtacaatatgttagtagagtttattcagacttagatacatgcttc

SEQ ID NO: 286 - protein, 304 aa, Nicotiana tabacum
METVEMIVKVSCAAIVITLLVCLWRVLNWVWFRPKKLEKLLRKQVLYGDMKEFSGMIKEAYSKPMSLSDDVAPRMMPFFLETIKKYGKRSFIWFGPRPLVLIMDPELIKEVLSKIYLYQKPGGNPLATLLVQGLATYEEDKWAKHRKIINPAFHLEKLKHMLPAFRLSCSEMLSKWEDIVSAEGSHEIDVWPNLEQLSCDVISRTAFGNSYEEGRKIFELQKEQTQHLVEAFRSVYIPGRRFLPTKRNRRMKEIKKEVRASIKGIIDKRLKAMKAGDTNNEDLLGYCWNQILKKLNSAETRILE

SEQ ID NO: 287 - DNA, 1559 bp, Nicotiana tabacum
ccaaaatgcagttcttcaacttcatttcctttgtcttttttgtgtctttcctctttttattaaggaaatggaagaactccaatagccaaaccaaaagattgcctccaggtccatggaaattacctgtacttggaagcatgtttcatttgctaggtggacctccacatcatgtccttggagatttagccaaaaaatatggtccacttatgcaccttcaactaggtgaagtttctgtagtttctgttacttctcctgagatggcaaaagaagtactaaaaactcatgacctcgcttttgcatctaggccgttacttttggcagccaaaattgtctgctataatgggacagacattgtcttttccccctatggcgattattggagacaaacgcgtaaaatttgtctcttggaattgctcagtgccaaaaatgttaggtcattcagctcagtcagacgagatgaagttttccatatgattgaatttttttcgatcatcttctggtaagccagttaatgtatcaaaaaggatttctctattcacaacctctatgacatgtagatcagcctttggacaagaatacaaggagcaagacgaattcgcacaactagtaaaaaaagtgtcaagcttaatggaagggtttgatgttgctgatatattcccttcattgaagtttcttcatgtgctcagtggaatgaaggctaaagttatggatgcacaccatgagttagatgccattcttgaaaaaattatcaatgagcacaagaaaattgcaactggaaagaataataatgaattaggaggtgaaggattaattgacgtactgctaagacttatgaaagagggaggccttcaattcccgatcaccaacgacaacatcaaagctattatttttgacatgtttggtgcgggaacggaaacttcatcaaccacaattgactgggccatggtcgaaatgataaagaatccaagtgtattcgctaaagctcaagcagaggtaagagaagccttcagagagaaagaaacttttgatgaaaatgatgtcgaggagttgaaatacttaaaattggttatcaaagaaactttcagactccatcctccatttccccttttgctcccaagagaatctagagaagaaacagatataaacggctacactattccttttaaaacaaaacttatggttaacgttcgggctattggaagagatccaaaatattgggatgacgtggaaagttttaagccagagagatttgagcacaactctatggattttattggtaataattttgaatatcttccctttggtagtggaaggagaatgtgccctgggatatcatttggtttggctaatgtttatttgccactagctcaattgttatatcattttgattggaaactccctactggaatcaattcaagtgacttggacatgactgagtcgtcaggagtaacttgtgctagaaagagtgatttatacttgactgctactccatatcaactttctcaagagtgatgcaatgatatcaaccttttgaatttcggtcaaccccaccaatagtg

SEQ ID NO: 288 - protein, 165 aa, Nicotiana tabacum
MQFFNFISFVFFVSFLFLLRKWKNSNSQTKRLPPGPWKLPVLGSMFHLLGGPPHHVLGDLAKKYGPLMHLQLGEVSVVSVTSPEMAKEVLKTHDLAFASRPLLLAAKIVCYNGTDIVFSPYGDYWRQTRKICLLELLSAKNVRSFSSVRRDEVFHMIEFFSIIFW

SEQ ID NO: 289 - DNA, 1601 bp, Nicotiana tabacum
ccccaccaaaaaatcatttctctcgtctaaaatggatcttctcttactagagaagaccttaattggtcttttctttgccattttaatcgctttaattgtctctaaacttcgttcaaagcgttttaagcttcctccaggaccaattccagtaccagtttttggtaattggcttcaagttggtgatgatttaaaccacagaaatcttactgattatgccaagaaatttggagatcttttcttgttaagaatgggtcaacgtaacttagttgttgtgtcatctcctgaattagctaaagaagttttacacacacaaggtgttgaatttggttcaagaacaagaaatgttgtgtttgatatttttactggaaaaggtcaagatatggtttttactgtatatggtgaacattggagaaaaatgaggagaattatgactgtaccattttttactaataaagttgtgcaacagtatagaggggggtgggagtttgaggtggcaagtgtaattgaggatgtgaaaaaaaatcctgaatctgctactaatgggatcgtattaaggaggagattacaattaatgatgtataataatatgtttaggattatgtttgataggagatttgagagtgaagatgatcctttgtttgttaagcttaaggctttgaatggtgaaaggagtagattggctcaaagttttgagtataattatggtgattttattccaattttgaggcctttttttgagaggttatttgaagatctgtaaagaagttaaggagaagaggctgcagcttttcaaagattactttgttgatgaaagaaagaagctttcgaataccaagagctcggacagcaatgccctaaaatgtgcgattgatcacattcttgaggctcaacagaagggagagatcaatgaggacaacgttctttacattgttgaaaacatcaatgttgctgcaattgaaacaacattatggtcaattgagtggggtatcgccgagctagtcaaccaccctcacatccaaaagaaactgcgcgacgagattgacacagttcttggaccaggagtgcaagtgactgaaccagacacccacaagcttccataccttcaggctgtgatcaaggaggcacttcgtctccgtatggcaattcctctattagtcccacacatgaaccttcacgacgcaaagcttggcgggtttgatattccagcagagagcaaaatcttggttaacgcttggtggttagctaacaacccggctcattggaagaaacccgaagagttcagacccgagaggttctttgaagaggagaagcatgttgaggccaatggcaatgacttcagatatcttccgtttggcgttggtaggaggagctgccctggaattatacttgcattgccaactcttggcatcactttgggacgtttggttcagaactttgagctgttgcctcctccaggccagtcgaagctcgacaccacagagaaaggtggacagttcagtctccacattttgaagcattccaccattgtgttgaaaccaaggtctttctgaactttgtgatcttattaattaaggggttctgaagaaatttgatagtgttgg

SEQ ID NO: 290 - protein, 242 aa, Nicotiana tabacum
MDLLLLEKTLIGLFFAILIALIVSKLRSKRFKLPPGPIPVPVFGNWLQVGDDLNHRNLTDYAKKFGDLFLLRMGQRNLVVVSSPELAKEVLHTQGVEFGSRTRNVVFDIFTGKGQDMVFTVYGEHWRKMRRIMTVPFFTNKVVQQYRGGWEFEVASVIEDVKKNPESATNGIVLRRRLQLMMYNNMFRIMFDRRFESEDDPLFVKLKALNGERSRLAQSFEYNYGDFIPILRPFFERLFEDL

SEQ ID NO: 291 - DNA, 1765 bp, Nicotiana tabacum
gtgaggtttgaatcctctgcctcaatgaaactcaccaaattggttttctaatttccatctaaaatattgtccaaagctaaagattctttctccttaaatagtcaactttagtggttcctcttcatttcatagctcaatctttcttattttgattcaaccatggagaaccaatactcctactcattctcttcctacttctacttagctatagtactgtttcttcttccaattttggtcaaatatttcttccatcggagaagaaatttacctccaagtccattttctcttccaataattggtcacctttaccttctcaagaaaactctccatctcactctaacatccttatcagctaaatatggtcctgttttatacctcaaattgggctctatgcctgtgattgttgtgtcctcaccatctgctgttgaagaatgtttaaccaagaatgatatcatattcgcaaataggcccaagaccgtggctggtgacaagtttacctacaattatactgtttatgtttgggcaccctatggccaactttggagaattcttcgccgattaactgtcgttgaactcttctcttcacatagcctacagaaaacttctatccttagagatcaagaagttgcaatatttatccgttcgttatacaaattctcaaaggatagtagcaaaaaagtcgatttgaccaactggtcttttactttggttttcaatcttatgaccaaaattattgctgggagacatattgtgaaggaggaagatgctggcaaggaaaagggcattgaaattattgaaaaacttagagggactttcttagtaactacatcattcttgaatatgtgtgatttcttgccagtattcaggtgggttggttacaaagggctggagaagaagatggcctcaattcacaatagaagaaatgaattcttgaacagcttgcttgatgaatttcgacacaagaaaagtagtgcttcacaatctaacacaactgttggaaacatggagaagaaaaccacactgattgaaaagctcttgtctcttcaagaatcagagcctgaattctacactgatgatatcatcaaaagtattatgctggtagtttttgttgcaggaacagagacctcatcaacaaccatccaatgggtaatgaggcttcttgtagctcaccctgaggcattgtataagctacgagctgacattgacagtaaagttgggaataagcgcttgctgaatgaatcagacctcaacaagcttccgtatttgcattgtgttgttaatgagacaatgagattatacactccgataccacttttattgcctcattattcaactaaagattgtattgtggaaggatatgatgtaccaaaacatacaatgttgtttgtcaacgcttgggccattcacagggatcccaaggtatgggaggagcctgacaagttcaagccagagagatttgaggcaacagaaggggaaacagaaaggttcaattacaagcttgtaccatttggaatggggagaagagcgtgccctggagctgatatggggttgcgagcagtttctttggcattaggtgcacttattcaatgctttgactggcaaattgaggaagcggaaagcttggaggaaagctataattctagaatgactatgcagaacaagcctttgaaggttgtctgcactccacgcgaagatcttggccagcttctatcccaactctaaggcaatttatcaatgccaaacgtaatcttcatctaccactatg

SEQ ID NO: 292 - protein, 520 aa, Nicotiana tabacum; identical to SEQ ID NO: 202

SEQ ID NO: 293 - DNA, 1694 bp, Nicotiana tabacum
aacatcctttccttcttccaaaaatggagcttcaatcttctcctttcaatttaatttctttgttcctcttcttttcttttctttttattctagtgaagaaatggaatgccaaaatcccaaagttacctccaggtccgtggaggcttccctttattggaagcctccatcacttgaagggaaaacttccacaccataatcttagagatctagcgcgaaaatatggacctctcatgtacttacaactcggagaaattcctgtagttgtaatatcttcgccacgtgtagcaaaagctgtactaaaaactcatgatctcgcttttgcaactagaccacgattcatgtcctcagacattgtgttttacaaaagcagggacatctcttttgccccatttggtgattactggagacagatgcgtaaaatattgactcaggaactcctgagcaacaagatgctcaagtcatatagcttaatccgaaaggatgagctctcgaagctcctctcatcgattcgtttggaaacaggttctgcagtgaacataaatgaaaagcttctctggtttacgagctgcatgacctgtagattagcctttggaaaaatatgcaatgatcgggatgagttgatcatgctaattagggagatattaacattatcaggaggatttgatgtgggtgatttgttcccttcctggaaattacttcataatatgagcaacatgaaagctaggttgacgaatgtacaccacaagtatgatttagttatggagaacatcatcaatgagcaccaagagaatcatgcagcagggataaagggtaacaacgagtttggtggcgaagatatgatcgatgctctactgagggctaaggagaataatgagcttcaatttcctatcgaaaatgacaacatgaaagcagtaattctggacttgtttattgctggaactgaaacttcatatactgcaattatatgggcactatcagaattgatgaagcacccaagtgtgatggccaaggcacaagctgaagtgagaaaagtcttcaaagaaaatgaaaatttcgacgaaaatgatcttgacaagttgccatacctaaaatcagtgattaaagaaacactaaggatgcaccctccagttcctttgttagggcctagagaatgcagggaccaaacagagatcgatggctacactgtacctattaaagctagagttatggttaatgcttgggcgataggaagagatcctgaaagttgggaagatcctgaaagtttcaaaccggagcgatttgaaaatacttctgttgatcttacaggaaatcactatcagttcattcctttcggttcaggaagaagaatgtgtccaggaatgtcgtttggtttagttaacacagggcatcctttagcccagttgctctattgctttgactggaaactccctgacaaggttaatgcaaatgattttcgcactactgaaacaagtagagtttttgcagcaagcaaagatgacctctacttgattcccacaaatcacagggagcaagaatagcttaatttaatggagttcttggaagaattaaagaagaagggctatataggtgagattttttgtatggttgcaaggtttttagttcatacaataagacaatacattatattccagtattgtgtatcatgtataataaggttccttttgtttaaaaaa

SEQ ID NO: 294 - protein, 504 aa, Nicotiana tabacum; identical to SEQ ID NO: 160

SEQ ID NO: 295 - DNA, 1819 bp, Nicotiana tabacum
caatcagtggatgcgggagtaatatataatatgcaagttgtagaaagagaaaaaaaaaatcaagtagctattctatactggggcacaaatagtgagtgaaaatggagactgttcaaatcataataacagcatcttgtgctgccataataattactctagtggtgtgtatttggagagtactgaattgggtttggttcagaccaaagaagctggaaaaactattgaggaaacaaggtctcaaaggcaactcctacaagattttgtatggggatatgaaggagctttctggtatgattaaggaagctaattccaaacccatgaatctttctgatgatattgcaccaagattggtgcctttctttcttgacaccatcaagaaatatggtaaaaaatcctttgtatggttaggtccgaaaccactggttcttatcatggaccctgagcttataaaggaaatattttccaaatactatctgtatcaaaagcctcatggaaatccagttaccaagctattagtacaaggactagtaagcctagaggaagacaaatgggccaaacatagaaaaatcatcaatccagctttccatctagagaagctaaagcatatgcttccagctttttgcttgagctgcactgagatgctgtgcaaatgggaagatattgtttcaattaagggctcacatgagatagatgtatggcctcaccttgaacaattaagtagcgatgtgatctctcggacagcttttggcagtaactttgaagaaggtaaaaggatatttgaacttcagaaggaacaagctcagtattttgtagaagctatacgctcggtttatataccaggctggaggtttttgccaacaaagaggaacagaagaatgaaggaagttgaaaaggatgttcgggcctcgataagaggcattattgataaaagagtgaaggcaatgaaagcaggagaggcgagtaatgaggatctacttggtatattgttggaatctaattttacagaagctgaacagcatagacacaaggattctgcgatgagcattgaagaagtcattcaagaatgcaagttattctatgttgctggccaagaaactacatcagtgttgcttgtgtggactctaatattgttgagtaggcatcaagattggcagagccgagccagagaagaggtgtttcaagtctttggtaatcagaaaccagattttgacggattgaatcgtctaaaagttgtgacaatgatcttgtatgagtctttaaggctatactccccagtagtgtcactaatccggcggcctaatgaggatgctatattaggaaatgtatctctgccagaaggtgtgctactctcattaccagtgatcttattacaccacgatgaagagatatggggtaaagatgcaaagaagttcaatccagaaagatttagagatggagtctcaagtgcaacaaagggtcaagtcactttttttccatttacttggggtcccagaatatgcatcggacaaaattttgccatgttagaagcaaagactgctttggctatgatcctacaacgcttctcattcgaactgtctccatcttatgcacatgctcctcagtccatattaactatgcaaccccaacatggtgctccactaattctgcacaaaatatagtttgttactttaagcagtgtcttgttatatgtcagagagtccaaaatgtttaattaaggcttgtagaactgccaaatggaacttcatttgcattcgtgggttgtagattgttgtaattggacaagtatactgtttattttagagttttaagaaaaaaaaaa

SEQ ID NO: 296 - protein, 518 aa, Nicotiana tabacum
METVQIIITASCAAIIITLVVCIWRVLNWVWFRPKKLEKLLRKQGLKGNSYKILYGDMKELSGMIKEANSKPMNLSDDIAPRLVPFFLDTIKKYGKKSFVWLGPKPLVLIMDPELIKEIFSKYYLYQKPHGNPVTKLLVQGLVSLEEDKWAKHRKIINPAFHLEKLKHMLPAFCLSCTEMLCKWEDIVSIKGSHEIDVWPHLEQLSSDVISRTAFGSNFEEGKRIFELQKEQAQYFVEAIRSVYIPGWRFLPTKRNRRMKEVEKDVRASIRGIIDKRVKAMKAGEASNEDLLGILLESNFTEAEQHRHKDSAMSIEEVIQECKLFYVAGQETTSVLLVWTLILLSRHQDWQSRAREEVFQVFGNQKPDFDGLNRLKVVTMILYESLRLYSPVVSLIRRPNEDAILGNVSLPEGVLLSLPVILLHHDEEIWGKDAKKFNPERFRDGVSSATKGQVTFFPFTWGPRICIGQNFAMLEAKTALAMILQRFSFELSPSYAHAPQSILTMQPQHGAPLILHKI

SEQ ID NO: 297 - protein, 83 aa, Nicotiana tabacum
EVLRLYPPGPLLVPHENVEDCVVSGYHIPKGTRLFANVMKLQRDPKLWSDPDTFDPERFIATDIDFRGQYYKYIPFGPGRRSC

SEQ ID NO: 298 - protein, 83 aa, Nicotiana tabacum
EVLRLYPPGPLLVPHENVEDCVVSGYHIPKGTRLFANVMKLLRDPKLWPDPDTFDPERFIATDIDFRGQYYKYIPFGSGRRSC

SEQ ID NO: 299 - protein, 83 aa, Nicotiana tabacum
EVLRLYPPGPLLVPHENVEDCVVSGYHIPKGTRLFANVMKLQRDPKLWSDPDTFDPERFIATDIDFRGQYYKYIPFGSGRRSC

SEQ ID NO: 300 - protein, 83 aa, Nicotiana tabacum
EVLRLYPPGPLLVPHENVEDCVVSGYHIPKGTRLFANVMKLQRDPKLWSNPDKFDPERFFADDIDYRGQHYEFIPFGSGRRSC

SEQ ID NO: 301 - protein, 83 aa, Nicotiana tabacum
KVLRLYPPGPLLVPHENVKDCVVSGYHIPKGTRLFANVMKLQRDPKLLSNPDKFDPERFIAGDIDFRGHHYEFIPSGSGRRSC

SEQ ID NO: 302 - protein, 83 aa, Nicotiana tabacum
KVLRLYPPGPLLVPHENVKDCVVSGYHIPKGTRLFANVMKLQRDPKLLSNPDKFDPERFIAGDIDFRGHHYEFIPFGSGRRSC

SEQ ID NO: 303 - protein, 83 aa, Nicotiana tabacum
KVLRLYPPGPLLVPHEYVKDCVVSGYHIPKGTRLFANVMKLQRDPKLLSNPDKFDPERFIAGDIDFRGHHYEFIPFGSGRRSC

SEQ ID NO: 304 - protein, 85 aa, Nicotiana tabacum
ETLRLYPPVPFLLPHEAVQDCKVTGYHIPKGTRLYINAWKVHRDPEIWSEPEKFMPNRFLTSKANIDARGQNFEFIPFGSGRRSC

SEQ ID NO: 305 - protein, 85 aa, Nicotiana tabacum; identical to SEQ ID NO: 304

SEQ ID NO: 306 - protein, 85 aa, Nicotiana tabacum
ETLRLFPPVPFLLPHEAVQDCKVTGYHIPKGTRLYINAWKVHRDPEIWSEPEKFMPNRFLTSKANIDARGQNFEFIPFGSGRRSC

SEQ ID NO: 307 - protein, 85 aa, Nicotiana tabacum; identical to SEQ ID NO: 306

SEQ ID NO: 308 - protein, 85 aa, Nicotiana tabacum
ETLRLYPPVPFLLPHEAVQDCKVTGYHIPKGTRLYINAWKVHRDSEIWSEPEKFMPNRFLTSKANIDARGQNFEFIPFGSGRRSC

SEQ ID NO: 309 - protein, 81 aa, Nicotiana tabacum
ETFRMYPAGPLLVPHESSEETTVGGYRVPGGTMLLVNLWAIHNDPKLWDEPRKFKPERFEGLEGVRDGYKMMPFGSGRRSC

SEQ ID NO: 310 - protein, 81 aa, Nicotiana tabacum
ETFRMYPAGPLLVPHESSEETTVGGYRVPGGTMLLVNLWAIHNDPKLWDEPRKFKPERFQGLDGVRDGYKMMPFGSGRRSC

SEQ ID NO: 311 - protein, 83 aa, Nicotiana tabacum
ETMRLYTPIPLLLPHYSTKDCIVEGYDVPKHTMLFVNAWAIHRDPKVWEEPDKFKPERFEATEGETERFNYKLVPFGMGRRAC

SEQ ID NO: 312 - protein, 83 aa, Nicotiana tabacum; identical to SEQ ID NO: 311

SEQ ID NO: 313 - protein, 83 aa, Nicotiana tabacum; identical to SEQ ID NO: 311

SEQ ID NO: 314 - protein, 83 aa, Nicotiana tabacum
ETMRLHPVAPMLVPRECREDIKVAGYDVQKGTRVLVSVWTIGRDPTLWDEPEVFKPERFHEKSIDVKGHDYELLPFGAGRRMC

SEQ ID NO: 315 - protein, 83 aa, Nicotiana tabacum; identical to SEQ ID NO: 314

SEQ ID NO: 316 - protein, 83 aa, Nicotiana tabacum
ETMRLHPVAPMLVPRECREDIKVAGYDVQKGTRVLVSVWTIGRDPTLWDEPEVFKPERFHERSIDVKGHDYELLPFGAGRRMC

SEQ ID NO: 317 - protein, 83 aa, Nicotiana tabacum
EALRLHPPTPLMLPHRASASVKIGGYDIPKGSIVHVNVWAVARDPAVWKNPLEFRPERFLEEDVDMKGHDYRLLPFGAGRRVC

SEQ ID NO: 318 - protein, 83 aa, Nicotiana tabacum
EALRLHPPTPLMLPHKASASVKIGGYDIPKGSIVHVNVWAVARDPAVWKNPLEFRPERFLEEDVDMKGHDYRLLPFGAGRRVC

SEQ ID NO: 319 - protein, 83 aa, Nicotiana tabacum
ETLRLHPLGTMLAPHCAIEDCNVAGYDIQKGTTFLVNVWTIGRDPKYWDRAQEFLPERFLENDIDMDGHNFAFLPFGSGRRRC

SEQ ID NO: 320 - protein, 83 aa, Nicotiana tabacum
ETLRLHPLGTMLAPHCAIEDCNVAGYDIQKGTTVLVNVWTIGRDPKYWDRAQEFLPERFLENDIDMDGHNFAFLPFGSGRRRC

SEQ ID NO: 321 - protein, 83 aa, Nicotiana tabacum; identical to SEQ ID NO: 320

SEQ ID NO: 322 - protein, 83 aa, Nicotiana tabacum
EVLRLYPAGYVINRMVNKETKLGNLCLPAGVQLVLPTMLLQHDTEIWGDDAMEFNPERFSDGISKATKGKLVFFPFSWGPRIC

SEQ ID NO: 323 - protein, 83 aa, Nicotiana tabacum; identical to SEQ ID NO: 322

SEQ ID NO: 324 - protein, 83 aa, Nicotiana tabacum
EVLRLYPAGYAINRMVTKETKLGNLCLPAGVQLLLPTILLQHDTEIWGDDAMEFNPERFSDGISKATKGKLVFFPFSWGPRIC

SEQ ID NO: 325 - protein, 83 aa, Nicotiana tabacum
ESLRLYPPIATRTRRTNEETKLGELDLPKGALLFIPTILLHLDKEIWGEDADEFNPERFSEGVAKATKGKMTYFPFGAGPRKC

SEQ ID NO: 326 - protein, 83 aa, Nicotiana tabacum
ESLRLYPPIATRTRRTNEETKLGELDLPKGALLFIPTILLHLDREIWGEDADEFNPERFSEGVAKATKGKMTYFPFGAGPRKC

SEQ ID NO: 327 - protein, 83 aa, Nicotiana tabacum
ETLRMHPPIPLLVPRECMEDTKIDGYNIPFKTRVIVNAWAIGRDPESWDDPESFMPERFENSSIDFLGNHHQFIPFGAGRRIC

SEQ ID NO: 328 - protein, 83 aa, Nicotiana tabacum; identical to SEQ ID NO: 327

SEQ ID NO: 329 - protein, 83 aa, Nicotiana tabacum; identical to SEQ ID NO: 327

SEQ ID NO: 330 - protein, 83 aa, Nicotiana tabacum
ETLRMHPPIPLLVPRECMEDTKIDGYNIPFKTRVIVNAWAIGRDPQSWDDPESFTPERFENNSIDFLGNHHQFIPFGAGRRIC

SEQ ID NO: 331 - protein, 83 aa, Nicotiana tabacum; identical to SEQ ID NO: 330

SEQ ID NO: 332 - protein, 83 aa, Nicotiana tabacum
ETLRMHPPVPLLGPRECRDQTEIDGYTVPIKARVMVNAWAIGRDPESWEDPESFKPERFENTSVDLTGNHYQFIPFGSGRRMC

SEQ ID NO: 333 - protein, 83 aa, Nicotiana tabacum; identical to SEQ ID NO: 332

SEQ ID NO: 334 - protein, 83 aa, Nicotiana tabacum; identical to SEQ ID NO: 332

SEQ ID NO: 335 - protein, 83 aa, Nicotiana tabacum
ETLRMHPPVPLLGPRECREQTEIDGYTVPLKARVMVNAWAIGRDPESWEDPESFKPERFENISVDLTGNHYQFIPFGSGRRMC

SEQ ID NO: 336 - protein, 83 aa, Nicotiana tabacum; identical to SEQ ID NO: 335

SEQ ID NO: 337 - protein, 83 aa, Nicotiana tabacum; identical to SEQ ID NO: 335

SEQ ID NO: 338 - protein, 83 aa, Nicotiana tabacum
ETLRLHPPTPLLVPRECREETEIEGFTIPLKSKVLVNVWAIGRDPENWKNPECFIPERFENSSIEFTGNHFQLLPFGAGRRIC

SEQ ID NO: 339 - protein, 83 aa, Nicotiana tabacum; identical to SEQ ID NO: 338

SEQ ID NO: 340 - protein, 83 aa, Nicotiana tabacum
ETLRLHPPVPLLLPRECREETNINGYTIPVKTKVMVNVWALGRDPKYWNDAETFMPERFEQCSKDFVGNNFEYLPFGGGRRIC

SEQ ID NO: 341 - protein, 83 aa, Nicotiana tabacum; identical to SEQ ID NO: 340

SEQ ID NO: 342 - protein, 83 aa, Nicotiana tabacum; identical to SEQ ID NO: 340

SEQ ID NO: 343 - protein, 83 aa, Nicotiana tabacum; identical to SEQ ID NO: 340

SEQ ID NO: 344 - protein, 83 aa, Nicotiana tabacum
ETLRLHPPVPLLLPRECREETNINGYTIPVKTKVMVNVWALGRDPKYWDDAETFKPERFEQCSKDFVGNNFEYLPFGGGRRIC

SEQ ID NO: 345 - protein, 83 aa, Nicotiana tabacum
ETLRLHPPIPLLLHETAEESTVSGYHIPAKSHVIINSFAIGRDKNSWEDPETYKPSRFLKEGVPDFKGGNFEFIPFGSGRRSC

SEQ ID NO: 346 - protein, 83 aa, Nicotiana tabacum; identical to SEQ ID NO: 345

SEQ ID NO: 347 - protein, 83 aa, Nicotiana tabacum
EIFRLYPPAPLLVPRESMEKTILEGYEIRPRTIVHVNAWAIARDPEIWENPDEFIPERFLNSSIDYKGQDFELLPFGAGRRGC

SEQ ID NO: 348 - protein, 83 aa, Nicotiana tabacum; identical to SEQ ID NO: 347

SEQ ID NO: 349 - protein, 83 aa, Nicotiana tabacum; identical to SEQ ID NO: 347

SEQ ID NO: 350 - protein, 83 aa, Nicotiana tabacum
EIFRLYPPAPLLVPRESMEKTILEGYEIRPRTIVHVNAWAIARDPEIWENPDEFIPERFLNSSTDYKGQDFELLPFGAGRRGC

SEQ ID NO: 351 - protein, 85 aa, Nicotiana tabacum
EALRLRMAIPLLVPHMNLHDAKLGGFDIPAESKILVNAWWLANNPAHWKKPEEFRPERFFEEEKHVEANGNDFRYLPFGVGRRSC

SEQ ID NO: 352 - protein, 85 aa, Nicotiana tabacum
EALRLRMAIPLLVPHMNLHDAKLGGLDIPAESKILVNAWWLANNPAHWKKPEEFRPERFFEEEKHVEANGNDFRYLPFGVGRRSC

SEQ ID NO: 353 - protein, 85 aa, Nicotiana tabacum
ETLRLRMAIPLLVPHMNLHDAKLGGFDIPAESKILVNAWWLANNPAHWKKPEEFRPERFFEEEKHVEANGNDFRYLPFGVGRRSC

SEQ ID NO: 354 - protein, 82 aa, Nicotiana tabacum
ESLRLYSPVVSLIRRPNEDAILGNVSLPEGVLLSLPVILLHHDEEIWGKDKKFNPERFRDGVSSATKGQVTFFPFTWGPRIC

SEQ ID NO: 355 - protein, 83 aa, Nicotiana tabacum
ESLRLYPPVVTLTRRPKEDTVLGDVSLPAGVLISLPVILLHHDEEIWGKDAKKFKPERFRDGVSSATKGQVTFFPFTWGPRIC

SEQ ID NO: 356 - DNA, 1573 bp, Nicotiana tabacum
atgctttctcccatagaagccattgtaggactagtaaccttcacatttctcttcttcttcctatggacaaaaaaatctcaaaaaccttcaaaacccttaccaccgaaaatccccggaggatggccggtaatcggccatcttttccacttcaatgacgacggcgacgaccgtccattagctcgaaaactcggagacttagctgacaaatacggccccgttttcacttttcggctaggccttccccttgtcttagttgtaagcagttacgaagctgtaaaagactgtttctctacaaatgacgccattttttccaatcgtccagcttttctttacggcgattaccttggctacaataatgccatgctatttttggccaattacggaccttactggcgaaaaaatcgaaaattagttattcaggaagttctctccgctagtcgtctcgaaaaattcaaacacgtgagatttgcaagaattcaagcgagcattaagaatttatatactcgaattgatggaaattcgagtacgataaatttaactgattggttagaagaattgaattttggtctgatcgtgaagatgatcgctgaaaaaaattatgaatccggtaaaggagatgaacaattggagagatttaagaaagcgtttaaggattttatgattttatcaatggagtttgtgttatgggatgcatttccaattccattatttaaatgggtggattttcaagggcatgttaaggctatgaaaaggacttttaaagatatagattctgtttttcagaattggttagaggaacatattaataaaagagaaaaaatggaggttaatgcagaagggaatgaacaagatttcattgatgtggtgctttcaaaaatgagtaatgaatatcttggtgaaggttactctcgtgatactgtcattaaagcaacggtgtttagtttggtcttggatgcagcagacacagttgctcttcacataaattggggaatggcattattgataaacaatcaaaaggccttgacgaaagcacaagaagagatagacacaaaagttggtaaggacagatgggtagaagagagtgatattaaggatttggtatacctccaagctattgttaaagaagtgttacgattatatccaccaggacctttgttagtaccacacgaaaatgtagaagattgtgttgttagtggatatcacattcctaaagggacaagattattcgcaaacgtcatgaaactgcaacgtgatcctaaactctggtctgatcctgatactttcgatccagagagattcattgctactgatattgactttcgtggtcagtactataagtatatcccgtttggttctggaagacgatcttgtccagggatgacttatgcattgcaagtggaacacttaacaatggcacatttgatccaaggtttcaattacagaactccaaatgacgagcccttggatatgaaggaaggtgcaggcataactatacgtaaggtaaatcctgtggaactgataatagcgcctcgcctggcacctgagctttattaaaacctaagatcatcttgct

SEQ ID NO: 357 - protein, 517 aa, Nicotiana tabacum
MLSPIEAIVGLVTFTFLFFFLWTKKSQKPSKPLPPKIPGGWPVIGHLFHFNDDGDDRPLARKLGDLADKYGPVFTFRLGLPLVLVVSSYEAVKDCFSTNDAIFSNRPAFLYGDYLGYNNAMLFLANYGPYWRKNRKLVIQEVLSASRLEKFKHVRFARIQASIKNLYTRIDGNSSTINLTDWLEELNFGLIVKMIAEKNYESGKGDEQLERFKKAFKDFMILSMEFVLWDAFPIPLFKWVDFQGHVKAMKRTFKDIDSVFQNWLEEHINKREKMEVNAEGNEQDFIDVVLSKMSNEYLGEGYSRDTVIKATVFSLVLDAADTVALHINWGMALLINNQKALTKAQEEIDTKVGKDRWVEESDIKDLVYLQAIVKEVLRLYPPGPLLVPHENVEDCVVSGYHIPKGTRLFANVMKLQRDPKLWSDPDTFDPERFIATDIDFRGQYYKYIPFGSGRRSCPGMTYALQVEHLTMAHLIQGFNYRTPNDEPLDMKEGAGITIRKVNPVELIIAPRLAPELY

SEQ ID NO: 358 - DNA, 1573 bp, Nicotiana tabacum
atgctttctcccatagaagccattgtaggactagtaaccttcacatttctcttcttcttcctatggacaaaaaaatctcaaaaaccttcaaaacccttaccaccgaaaatccccggaggatggccggtaatcggccatcttttccacttcaatgacgacggcgacgaccgtccattagctcgaaaactcggagacttagctgacaaatacggccccgttttcacttttcggctaggccttccccttgtcttagttgtaagcagttacgaagctgtaaaagactgtttctctacaaatgacgccattttttccaatcgtccagcttttctttacggcaattaccttggctacaataatgccatgctatttttggccaattacggaccttactggcgaaaaaatcgaaaattagttattcaggaagttctctccgctagtcgtctcgaaaaattcaaacacgtgagatttgcaagaattcaagcgagcattaagaatttatatactcgaattgatggaaattcgagtacgataaatttaactgattggttagaagaattgaattttggtctgatcgtgaagatgatcgctggaaaaaattatgaatccggtaaaggagatgaacaagtggagagatttaagaaagcgtttaaggatcttatgattttatcaatggagtttgtgttatgggatgcatttccaattccattatttaaatgggtggattttcaagggcatgttaaggctatgaaaaggacttttaaagatatagattctgtttttcagaattggttagaggaacatattaataaaagagaaaaaatggaggttaatgcagaagggaatgaacaagatttcattgatgtggtgctttcaaaaatgagtaatgaatatcttggtgaaggttactctcgtgatactgtcattaaagcaacggtgtttagtttggtcttggatgcagcagacacagttgctcttcacataaattggggaatggcattattgataaacaatcaaaaggccttgacgaaagcacaagaagagatagacacaaaagttggtaaggacagatgggtagaagagagtgatattaaggatttggtatacctccaagctattgttaaagaagtgttacgattatatccaccaggacctttgttagtaccacacgaaaatgtagaagattgtgttgttaggggatatcacattcctaaagggacaagattattcgcaaacgtcatgaaactgcaacgtgatcctaaactctggtctgatcctgatactttcgatccagagagattcattgctactgatattgactttcgtggtcagtactataagtatatcccgtttggttctggaagacgatcttgtccagggatgacttatgcattgcaagtggaacacttaacaatggcacatttgatccaaggtttcaattacagaactccaaatgacgagcccttggatatgaaggaaggtgcaggcataactatacgtaaggtaaatcctgtggaactgataatagcgcctcgcctggcacctgagctttattaaaacctaagatcatcttgct

SEQ ID NO: 359 - protein, 517 aa, Nicotiana tabacum
MLSPIEAIVGLVTFTFLFFFLWTKKSQKPSKPLPPKIPGGWPVIGHLFHFNDDGDDRPLARKLGDLADKYGPVFTFRLGLPLVLVVSSYEAVKDCFSTNDAIFSNRPAFLYGNYLGYNNAMLFLANYGPYWRKNRKLVIQEVLSASRLEKFKHVRFARIQASIKNLYTRIDGNSSTINLTDWLEELNFGLIVKMIAGKNYESGKGDEQVERFKKAFKDLMILSMEFVLWDAFPIPLFKWVDFQGHVKAMKRTFKDIDSVFQNWLEEHINKREKMEVNAEGNEQDFIDVVLSKMSNEYLGEGYSRDTVIKATVFSLVLDAADTVALHINWGMALLINNQKALTKAQEEIDTKVGKDRWVEESDIKDLVYLQAIVKEVLRLYPPGPLLVPHENVEDCVVRGYHIPKGTRLFANVMKLQRDPKLWSDPDTFDPERFIATDIDFRGQYYKYIPFGSGRRSCPGMTYALQVEHLTMAHLIQGFNYRTPNDEPLDMKEGAGITIRKVNPVELIIAPRLAPELY

SEQ ID NO: 360 - DNA, 1573 bp, Nicotiana tabacum
atgctttctcccatagaagccattgtaggactagtaaccttcacatttctcttcttcttcctatggacaaaaaaatctcaaaaaccttcaaaacccttaccaccgaaaatccccggaggatggccggtaatcggccatcttttccacttcaatgacgacggcgacgaccgtccattagctcgaaaactcggagacttagctgacaaatacggccccgttttcacttttcggctaggccttccccttgtcttagttgtaagcagttacgaagctgtaaaagactgtttctctacaaatgacgccattttttccaatcgtccagcttttctttacggcgattaccttggctacaataatgccatgctatttttggccaattacggaccttactggcgaaaaaatcgaaaattagttattcaggaagttctctccgctagtcgtctcgaaaaattcaaacacgtgagatttgcaagaattcaagcgagcattaagaatttatatactcgaattgatggaaattcgagtacgataaatttaactgattggttagaagaattgaattttggtctgatcgtgaagatgatcgctggaaaaaattatgaatccggtaaaggagatgaacaagtggagagatttaagaaagcgtttaaggattttatgattttatcaatggagtttgtgttatgggatgcatttccaattccattatttaaatgggtggattttcaagggcatgttaaggctatgaaaaggacttttaaagatatagattctgtttttcagaattggttagaggaacatattaataaaagagaaaaaatggaggttaatgcagaagggaatgaacaagatttcattgatgtggtgctttcaaaaatgagtaatgaatatcttggtgaaggttactctcgtgatactgtcattaaagcaacggtgtttagtttggtcttggatgcagcagacacagttgctcttcacataaattggggaatggcattattgataaacaatcaaaaggccttgacgaaagcacaagaagagatagacacaaaagttggtaaggacagatgggtagaagagagtgatattaaggatttggtatacctccaagctattgttaaagaagtgttacgattatatccaccaggacctttgttagtaccacacgaaaatgtagaagattgtgttgttagtggatatcacattcctaaagggacaagattattcgcaaacgtcgtgaaactgcaacgtgatcctaaactctggtctgatcctgatactttcgatccagagagattcattgctactgatattgactttcgtggtcagtactataagtatatcccgtttggttctggaagacgatcttgtccagggatgacttatgcattgcaagtggaacacttaacaatggcacatttgatccaaggtttcaattacagaactccaaatgacgagcccttggatatgaaggaaggtgcaggcataactatacgtaaggtaaatcctgtggaactgataatagcgcctcgcctggcacctgagctttattaaaacctaagatcatcttgct

SEQ ID NO: 361 - protein, 517 aa, Nicotiana tabacum
MLSPIEAIVGLVTFTFLFFFLWTKKSQKPSKPLPPKIPGGWPVIGHLFHFNDDGDDRPLARKLGDLADKYGPVFTFRLGLPLVLVVSSYEAVKDCFSTNDAIFSNRPAFLYGDYLGYNNAMLFLANYGPYWRKNRKLVIQEVLSASRLEKFKHVRFARIQASIKNLYTRIDGNSSTINLTDWLEELNFGLIVKMIAGKNYESGKGDEQVERFKKAFKDFMILSMEFVLWDAFPIPLFKWVDFQGHVKAMKRTFKDIDSVFQNWLEEHINKREKMEVNAEGNEQDFIDVVLSKMSNEYLGEGYSRDTVIKATVFSLVLDAADTVALHINWGMALLINNQKALTKAQEEIDTKVGKDRWVEESDIKDLVYLQAIVKEVLRLYPPGPLLVPHENVEDCVVSGYHIPKGTRLFANVVKLQRDPKLWSDPDTFDPERFIATDIDFRGQYYKYIPFGSGRRSCPGMTYALQVEHLTMAHLIQGFNYRTPNDEPLDMKEGAGITIRKVNPVELIIAPRLAPELY

SEQ ID NO: 362 - DNA, 1577 bp, Nicotiana tabacum
cataatgctttctcccatagaagccattgtaggactagtaaccttcacatttctcttcttcttcctatggacaaaaaaatctcaaaaaccttcaaaacccttaccaccgaaaatccccggaggatggccggtaatcggccatcttttccacttcaatgacgacggcgacgaccgtccattagctcgaaaactcggagacttagctgacaaatacggccccgttttcacttttcggctaggccttccccttgtcttagttgtaagcagttacgaagctgtaaaagactgtttctctacaaatgacgccattttttccaatcgtccagcttttctttacggcgattaccttggctacaataatgccatgctatttttggccaattacggaccttactggcgaaaaaatcgaaaattagttattcaggaagttctctccgctagtcgtctcgaaaaattcaaacacgtgagatttgcaagaattcaagcgagcattaagaatttatatactcgaattgatggaaattcgagtacgataaatttaactgattggttagaagaattgaattttggtctgatcgtgaagatgatcgctggaaaaaattatgaatccggtaaaggagatgaacaagtggagagatttaagaaagcgtttaaggattttatgattttatcaatggagtttgtgttatgggattcatttccaattccattatttaaatgggtggattttcaagggcatgttaaggctatgaaaaggacttttaaagatatagattctgtttttcagaattggttagaggaacatattaataaaagagaaaaaatggaggttaatgcagaagggaatgaacaagatttcattgatgtggtgctttcaaaaatgagtaatgaatatcttggtgaaggttactctcgtgatactgtcattaaagcaacggtgtttagtttggtcttggatgcagcagacacagttgctcttcacataaattggggaatggcattattgatgaacaatcaaaaggccttgacgaaagcacaagaagagatagacacaaaagttggtaaggacagatgggtagaagagagtgatattaaggatttggtatacctccaagctattgttaaagaagtgttacgattatatccaccaggacctttgttagtaccacacgaaaatgtagaagattgtgttgttagtggatatcacattcctaaagggacaagattattcgcaaacgtcatgaaactgcaacgtgatcctaaactctggtctgatcctgatactttcgatccagagagattcattgctactgatattggctttcgtggtcagtactataagtatatcccgtttggttctggaagacgatcttgtccagggatgacttatgcattgcaagtggaacacttaacaatggcacatttgatccaaggtttcaattacagaactccaaatgacgagcccttggatatgaaggaaggtgcaggcataactatacgtaaggtaaatcctgtggaactgataatagcgcctcgcctggcacctgagctttattaaaacctaagatcatcttgct

SEQ ID NO: 363 - protein, 517 aa, Nicotiana tabacum
MLSPIEAIVGLVTFTFLFFFLWTKKSQKPSKPLPPKIPGGWPVIGHLFHFNDDGDDRPLARKLGDLADKYGPVFTFRLGLPLVLVVSSYEAVKDCFSTNDAIFSNRPAFLYGDYLGYNNAMLFLANYGPYWRKNRKLVIQEVLSASRLEKFKHVRFARIQASIKNLYTRIDGNSSTINLTDWLEELNFGLIVKMIAGKNYESGKGDEQVERFKKAFKDFMILSMEFVLWDSFPIPLFKWVDFQGHVKAMKRTFKDIDSVFQNWLEEHINKREKMEVNAEGNEQDFIDVVLSKMSNEYLGEGYSRDTVIKATVFSLVLDAADTVALHINWGMALLMNNQKALTKAQEEIDTKVGKDRWVEESDIKDLVYLQAIVKEVLRLYPPGPLLVPHENVEDCVVSGYHIPKGTRLFANVMKLQRDPKLWSDPDTFDPERFIATDIGFRGQYYKYIPFGSGRRSCPGMTYALQVEHLTMAHLIQGFNYRTPNDEPLDMKEGAGITIRKVNPVELIIAPRLAPELY

SEQ ID NO: 364 - DNA, 1573 bp, Nicotiana tabacum
atgctttctcccatagaagccattgtaggactagtaaccttcacatttctcttcttcttcctatggacaaaaaaatctcaaaaaccttcaaaacccttaccaccgaaaatccccggaggatggccggtaatcggccatcttttccacttcaatgacgacggcgacgaccgtccattagctcgaaaactcggagacttagctgacaaatacggccccgttctcacttttcggctaggccttccccttgtcttagttgtaagcagttacgaagctgtaaaagactgtttctctacaaatgacgccattttttccaatcgtccagcttttctttacggcgattaccttggctacaataatgccatgctatttttggccaattacggaccttactggcgaaaaaatcgaaaattagttattcaggaagttctctccgctagtcgtctcgaaaaattcaaacacgtgagatttgcaagaattcaagcgagcattaagaatttatatactcgaattgatggaaattcgagtacgataaatttaactgattggttagaagaattgaattttggtctgatcgtgaagatgatcgctggaaaaaattatgaatccggtaaaggagatgaacaagtggagagatttaagaaagcgtttaaggattttatgattttatcaatggagtttgtgttatgggatgcatttccaattccattatttaaatgggtggactttcaagggcatgttaaggctatgaaaaggacttttaaagatatagattctgtttttcagaattggttagaggaacatattaataaaagagaaaaaatggaggttaatgcagaagggaatgaacaagatttcattgatgtggtgctttcaaaaatgagtaatgaatatcttggtgaaggttactctcgtgatactgtcattaaagcaacggtgtttagtttggtcttggatgcagcagacacagttgctcttcacataaattggggaatggcattattgataaacaatcaaaaggccttgacgaaagcacaagaagagatagacacaaaagttggtaaggacagatgggtagaagagagtgatattaaggatttggtatacctccaagctattgttaaagaagtgttacgattatatccaccaggacctttgttagtaccacacgaaaatgtagaagattgtgttgttagtggatatcacattcctaaagggacaagattattcgcaaacgtcatgaaactgcaacgtgatcctaaactctggtctgatcctgatactttcgatccagagagattcattgctactgatattgactttcgtggtcagtactataagtatatcccgtttggttctggaagacgatcttgtccagggatgacttatgcattgcaagtggaacacttaacaatggcacatttgatccaaggtttcaattacagaactccaaatgacgagcccttggatatgaaggaaggtgcaggcataactatacgtaaggtaaatcctgtggaactgataatagcgcctcgcctggcacctgagctttattaaaacctaagatcatcttgct

SEQ ID NO: 365 - protein, 517 aa, Nicotiana tabacum
MLSPIEAIVGLVTFTFLFFFLWTKKSQKPSKPLPPKIPGGWPVIGHLFHFNDDGDDRPLARKLGDLADKYGPVFTFRLGLPLVLVVSSYEAVKDCFSTNDAIFSNRPAFLYGDYLGYNNAMLFLANYGPYWRKNRKLVIQEVLSASRLEKFKHVRFARIQASIKNLYTRIDGNSSTINLTDWLEELNFGLIVKMIAGKNYESGKGDEQVERFKKAFKDFMILSMEFVLWDAFPIPLFKWVDFQGHVKAMKRAFKDIDSVFQNWLEEHINKREKMEVNAEGNEQDFIDVVLSKMSNEYLGEGYSRDTVIKATVFSLVLDAADTVALHINWGMALLINNQKALTKAQEEIDTKVGKDRWVEESDIKDLVYLQAIVKEVLRLYPPGPLLVPHENVEDCVVSGYHIPKGTRLFVNVMKLQRDPKLWSDPDTFDPERFIATDIDFRGQYYKYIPFGSGRRSCPGMTYALQVEHLTMAHLIQGFNYRTPNDEPLDMKEGAGITIRKVNPVELIIAPRLAPELY

SEQ ID NO: 366 - DNA, 1573 bp, Nicotiana tabacum
atgctttctcccatagaagccattgtaggactagtaaccttcacatttctcttcttcttcctatggacaaaaaaatctcaaaaaccttcaaaacccttaccaccgaaaatccccggaggatggccggtaatcggccatcttttccacttcaatgacgacggcgatgaccgtccattagctcgaaaactcggagacttagctgacaaatacggccccgttttcacttttcggctaggccttccccttgtcttagttgtaagcagttacgaagctgtaaaagactgtttctctacaaatgacgccattttttccaatcgtccagcttttctttacggcgattaccttggctacaataatgccatgctatttttggccaattacggaccttactggcgaaaaaatcgaaaattagttattcaggaagttctctccgctagtcgtctcgaaaaattcaaacacgtgagatttgcaagaattcaagcgagcattaagaatttatatactcgaattgatggaaattcgagtacgataaatttaactgattggttagaagaattgaattttggcctgatcgtgaagatgatcgctggaaaaaattatgaatccggtaaaggagatgaacaagtggagagatttaagaaagcgtttaaggattttatgattttatcaatggagtttgtgttatgggatgcatttccaattccattatttaaatgggtggattttcaagggcatgttaaggctatgaaaagggcttttaaagatatagattctgtttttcagaattggttagaggaacatattaataaaagagaaaaaatggaggttaatgcagaagggaatgaacaagatttcattgatgtggtgctttcaaaaatgagtaatgaatatcttggtgaaggttactctcgtgatactgtcattaaagcaacggtgtttagtttggtcttggatgcagcagacacagttgctcttcacataaattggggaatggcattattgataaacaatcaaaaggccttgacgaaagcacaagaagagatagacacaaaagttggtaaggacagatgggtagaagagagtgatattaaggatttggtatacctccaagctattgttaaagaagtgttacgattatatccaccaggacctttgttagtaccacacgaaaatgtagaagattgtgttgttagtggatatcacattcctaaagggacaagattattcgtaaacgtcatgaaactgcaacgtgatcctaaactctggtctgatcctgatactttcgatccagagagattcattgctactgatattgactttcgtggtcagtactataagtatatcccgtttggttctggaagacgatcttgtccagggatgacttatgcattgcaagtggaacacttaacaatggcacatttgatccaaggtttcaattacagaactccaaatgacgagcccttggatatgaaggaaggtgcaggcataactatacgtaaggtaaatcctgtggaactgataatagcgcctcgcctggcacctgagctttattaaaacctaagatcatcttgct

SEQ ID NO: 367 - protein, 517 aa, Nicotiana tabacum; identical to SEQ ID NO: 365

SEQ ID NO: 368 - DNA, 1573 bp, Nicotiana tabacum
atgctttctcccatagaagccattgtaggactagtaaccttcacatttctcttcttcttcctatggacaaaaaaatctcaaaaaccttcaaaacccttaccaccgaaaatccccggaggatggccggtaatcggccatcttttccacttcaatgacgacggcgacgaccgtccattagctcgaaaactcggagacttagctgacaaatacggccccgttttcacttttcggctaggccttccccttgtcttagttgtaagcagttacgaagctgtaaaagactgtttctctacaaatgacgccattttttccaatcgtccagcttttctttacggcgattaccttggctacaataatgccatgctatttttggccaattacggaccttactggcgaaaaaatcgaaaattagttattcaggaagttctctccgctagtcgtctcgaaaaattcaaacacgtgagatttgcaagaattcaagcgagcattaagaatttatatactcgaattgatggaaattcgagtacgataaatttaactgattggttagaagaattgaattttggtctggtcgtgaagatgatcgctggaaaaaattatgaatccggtaaaggagatgaacaagtggagagatttaagaaagcgtttgaggattttatgattttatcaatggagtttgtgttatgggatgcatttccaattccattatttaaatgggtggattttcaagggcatgttaaggctatgaaaaggacttttaaagatatagattctgtttttcagaattggttagaggaacatattaataaaagagaaaaaatggaggttaatgcagaagggaatgaacaagatttcattgatgtggtgctttcaaaaatgagtaatgaatatcttggtgaaggttactctcgtgatactgtcattaaagcaacggtgtttagtttggtcttggatgcagcagacacagttgctcttcacataaattggggaatggcattattgataaacaatcaaaaggccttgacgaaagcacaagaagagatagacacaaaagttggtaaggacagatgggtagaagagagtgatattaaggatttggtatacctccaagctattgttaaagaagtgttacgattatatccaccaggacctttgttagtaccacacgaaaatgtagaagattgtgttgttagtggatatcacattcctaaagggacaagattattcgcaaacgtcatgaaactgcaacgtgatcctaaactctggtctgatcctgatactttcgatccagagagattcattgctactgatattgactttcgtggtcagtactataagtatatcccgtttggttctggaagacgatcttgtccagggatgacttatgcattgcaagtggaacacttaacaatggcacatttgatccaaggtttcaattacagaactccaaatgacgagcccttggatatgaaggaaggtgcaggcataactatacgtaaggtaaatcctgtggaactgataatagcgcctcgcctggcacctgagctttattaaaacctaagatcatcttgct

SEQ ID NO: 369 - protein, 517 aa, Nicotiana tabacum
MLSPIEAIVGLVTFTFLFFFLWTKKSQKPSKPLPPKIPGGWPVIGHLFHFNDDGDDRPLARKLGDLADKYGPVFTFRLGLPLVLVVSSYEAVKDCFSTNDAIFSNRPAFLYGDYLGYNNAMLFLANYGPYWRKNRKLVIQEVLSASRLEKFKHVRFARIQASIKNLYTRIDGNSSTINLTDWLEELNFGLVVKMIAGKNYESGKGDEQVERFKKAFEDFMILSMEFVLWDAFPIPLFKWVDFQGHVKAMKRTFKDIDSVFQNWLEEHINKREKMEVNAEGNEQDFIDVVLSKMSNEYLGEGYSRDTVIKATVFSLVLDAADTVALHINWGMALLINNQKALTKAQEEIDTKVGKDRWVEESDIKDLVYLQAIVKEVLRLYPPGPLLVPHENVEDCVVSGYHIPKGTRLFANVMKLQRDPKLWSDPDTFDPERFIATDIDFRGQYYKYIPFGSGRRSCPGMTYALQVEHLTMAHLIQGFNYRTPNDEPLDMKEGAGITIRKVNPVELIIAPRLAPELY

SEQ ID NO: 370 - DNA, 1573 bp, Nicotiana tabacum
atgctttctcccatagaagccattgtaggactagtaaccttcacatttctcttcttcttcctatggacaaaaaaatctcaaaaaccttcaaaacccttaccaccgaaaatccccggaggatggccggtaatcggccatcttttccacttcaatgacgacggcgacgaccgtccattagctcaaaaactcggagacttagctgacaaatacggccccgttttcacttttcggctaggccttccccttgtcttagttgtaagcagttacgaagctgtaaaagactgtttctctacagatgacgccattttttccaatcgtccagcttttctttacggcgattaccttggctacaataatgccatgctatttttggccaattacggaccttactggcgaaaaaatcgaaaattagttattcaggaagttctctccgctagtcgtctcgaaaaattcaaacacgtgagatttgcaagaattcaagcgagcattaagaatttatatactcgaattgatggaaattcgagtacgataaatttaactgattggttagaagaattgaattttggtctgatcgtgaagatgatcgctggaaaaaattatgaatccggtaaaggagatgaacaagtggagagatttaagaaagcgtttaaggattttatgattttatcaatggagtttgtgttatgggatgcatttccaattccattatttaaatgggtggattttcaagggcatgttaaggctatgaaaaggacttttaaagatatagattctgtttttcagaattggttagaggaacatattaataaaagagaaaaaatggaggttaatgcagaagggaatgaacaagatttcattgatgtggtgctttcaaaaatgagtaatgaatatcttggtgaaggttactctcgtgatactgtcattaaagcaacggtgtttggtttggtcttggatgcagcagacacagttgctcttcacataaattggggaatggcattattgataaacaatcaaaaggccttgacgaaagcacaagaagagatagacacaaaagttggtaaggacagatgggtagaagagagtgatattaaggatttggtatacctccaagctattgttaaagaagtgttacgattatatccaccaggacctttgttagtaccacacgaaaatgtagaagattgtgttgttagtggatatcacattcctaaagggacaagattattcgcaaacgtcatgaaactgcaacgtgatcctaaactctggtctgatcctgatactttcgatccagagagattcattgctactgatattgactttcgtggtcagtactataagtatatcccgtttggttctggaagacgatcttgtccagggatgacttatgcattgcaagtggaacacttaacaatagcacatttgatccaaggtttcaattacagaactccaaatgacgagcccttggatatgaaggaaggtgcaggcataactatacgtaaggtaaatcctgtggaactgataatagcgcctcgcctggcacctgagctttattaaaacctaagatcatcttgct

SEQ ID NO: 371 - protein, 517 aa, Nicotiana tabacum
MLSPIEAIVGLVTFTFLFFFLWTKKSQKPSKPLPPKIPGGWPVIGHLFHFNDDGDDRPLAQKLGDLADKYGPVFTFRLGLPLVLVVSSYEAVKDCFSTDDAIFSNRPAFLYGDYLGYNNAMLFLANYGPYWRKNRKLVIQEVLSASRLEKFKHVRFARIQASIKNLYTRIDGNSSTINLTDWLEELNFGLIVKMIAGKNYESGKGDEQVERFKKAFKDFMILSMEFVLWDAFPIPLFKWVDFQGHVKAMKRTFKDIDSVFQNWLEEHINKREKMEVNAEGNEQDFIDVVLSKMSNEYLGEGYSRDTVIKATVFGLVLDAADTVALHINWGMALLINNQKALTKAQEEIDTKVGKDRWVEESDIKDLVYLQAIVKEVLRLYPPGPLLVPHENVEDCVVSGYHIPKGTRLFANVMKLQRDPKLWSDPDTFDPERFIATDIDFRGQYYKYIPFGSGRRSCPGMTYALQVEHLTIAHLIQGFNYRTPNDEPLDMKEGAGITIRKVNPVELIIAPRLAPELY

SEQ ID NO: 372 - DNA, 1575 bp, Nicotiana tabacum
atgctttctcccatagaagccattgtaggactagtaaccttcacatttctcttcttcttcctatggacaaaaaaatctcaaaaaccttcaaaacccttaccaccgaaaatccccggaggatggccggtaatcggccatcttttccacttcaatgacgacggcgacgaccgtccattagctcgaaaactcggagacttagctgacaaatacggccccgttttcacttttcggctaggccttccccttgtcttagttgtaagcagttacgaagctgtaaaagactgtttctctacaaatgacgccattttttccaatcgtccagcttttctttacggcgattaccttggctacaataatgccatgctatttttggccaattacggaccttactggcgaaaaaatcgaaaattagttattcaggaagttctctccgctagtcgtctcgaaaaattcaaacacgtgagatttgcaagaattcaagcgagcattaagaatttatatactcgaattgatggaaattcgagtacgataaatttaactgattggttagaagaattgaattttggtctgatcgtgaagatgatcgctggaaaaaattatgaatccggtaaaggagatgaacaagtggagagatttaagaaagcgtttaaggattttatgattttatcaatggagtttgtgttatgggatgcatttccaattccattatttaaatgggtggattttcaagggcatgttaaggctatgaaaaggacttttaaagatatagattctgtttttcagaattggttagaggaacatattaataaaagagaaaaaatggaggttaatgcagaagggaatgaacaagatttcattgatgtggtgctttcaaaaatgagtaatgaatatcttggtgaaggttactctcgtgatactgtcattaaagcaacggtgtttagtttggtcttggatgcagcagacacagttgctcttcacataaattggggaatggcattattgataaacaatcaaaaggccttgacgaaagcacaagaagagatagacacaaaagttggtaaggacagatgggtagaagagagtgatattaaggatttggtatacctccaagctattgttaaagaagtgttacgattatatccaccaggacctttgttagtaccacacgaaaatgtagaagattgtgttgttagtggatatcacattcctaaagggacaagattattcgcaaacgtcatgaaactgcaacgtgatcctaaactctggtctgatcctgatactttcgatccagagagattcattgctactgatattgactttcgtggtcagtactataagtatatcccgtttggttctggaagacgatcttgtccagggatgacttatgcattgcaagtggaacacttaacaatggcacatttgatccaaggtttcaattacagaactccaaatgacgagccctcggatatgaaggaaggtgcaggcataactatacgtaaagtaaatcctgtggaactgataatagcgcctcgcctggcacctgagctttattaaaacctaagatcatcttgcttg

SEQ ID NO: 373 - protein, 517 aa, Nicotiana tabacum
MLSPIEAIVGLVTFTFLFFFLWTKKSQKPSKPLPPKIPGGWPVIGHLFHFNDDGDDRPLARKLGDLADKYGPVFTFRLGLPLVLVVSSYEAVKDCFSTNDAIFSNRPAFLYGDYLGYNNAMLFLANYGPYWRKNRKLVIQEVLSASRLEKFKHVRFARIQASIKNLYTRIDGNSSTINLTDWLEELNFGLIVKMIAGKNYESGKGDEQVERFKKAFKDFMILSMEFVLWDAFPIPLFKWVDFQGHVKAMKRTFKDIDSVFQNWLEEHINKREKMEVNAEGNEQDFIDVVLSKMSNEYLGEGYSRDTVIKATVFSLVLDAADTVALHINWGMALLINNQKALTKAQEEIDTKVGKDRWVEESDIKDLVYLQAIVKEVLRLYPPGPLLVPHENVEDCVVSGYHIPKGTRLFANVMKLQRDPKLWSDPDTFDPERFIATDIDFRGQYYKYIPFGSGRRSCPGMTYALQVEHLTMAHLIQGFNYRTPNDEPSDMKEGAGITIRKVNPVELIIAPRLAPELY

SEQ ID NO: 374 - DNA, 25 bp, Artificial Sequence
  Probe Sequence
gaaagcgtttaaggattttatgatt

SEQ ID NO: 375 - DNA, 25 bp, Artificial Sequence
  Probe Sequence
gattttatcaatggagtttgtgtta

SEQ ID NO: 376 - DNA, 25 bp, Artificial Sequence
  Probe Sequence
ttatgggatgcatttccaattccat

SEQ ID NO: 377 - DNA, 25 bp, Artificial Sequence
  Probe Sequence
tgggatgcatttccaattccattat

SEQ ID NO: 378 - DNA, 25 bp, Artificial Sequence
  Probe Sequence
ggatgcatttccaattccattattt

SEQ ID NO: 379 - DNA, 25 bp, Artificial Sequence
  Probe Sequence
gatgcatttccaattccattattta

SEQ ID NO: 380 - DNA, 25 bp, Artificial Sequence
  Probe Sequence
tgcatttccaattccattatttaaa

SEQ ID NO: 381 - DNA, 25 bp, Artificial Sequence
  Probe Sequence
gcatttccaattccattatttaaat

SEQ ID NO: 382 - DNA, 25 bp, Artificial Sequence
  Probe Sequence
tatttaaatgggtggattttcaagg

SEQ ID NO: 383 - DNA, 25 bp, Artificial Sequence
  Probe Sequence
attttcaagggcatgttaaggctat

SEQ ID NO: 384 - DNA, 25 bp, Artificial Sequence
  Probe Sequence
caagggcatgttaaggctatgaaaa

SEQ ID NO: 385 - DNA, 25 bp, Artificial Sequence
  Probe Sequence
ggcatgttaaggctatgaaaaggac

SEQ ID NO: 386 - DNA, 25 bp, Artificial Sequence
  Probe Sequence
tgttaaggctatgaaaaggactttt

SEQ ID NO: 387 - DNA, 25 bp, Artificial Sequence
  Probe Sequence
aaggttactctcgtgatactgtcat

SEQ ID NO: 388 - DNA, 25 bp, Artificial Sequence
  Probe Sequence
gcagacacagttgctcttcacataa

SEQ ID NO: 389 - DNA, 25 bp, Artificial Sequence
  Probe Sequence
acagttgctcttcacataaattggg

SEQ ID NO: 390 - DNA, 25 bp, Artificial Sequence
  Probe Sequence
ggtatacctccaagctattgttaaa

SEQ ID NO: 391 - DNA, 25 bp, Artificial Sequence
  Probe Sequence
gtgttacgattatatccaccaggac

SEQ ID NO: 392 - DNA, 25 bp, Artificial Sequence
  Probe Sequence
tacgattatatccaccaggaccttt

SEQ ID NO: 393 - DNA, 25 bp, Artificial Sequence
  Probe Sequence
ccaggacctttgttagtaccacacg

SEQ ID NO: 394 - DNA, 25 bp, Artificial Sequence
  Probe Sequence
cctttgttagtaccacacgaaaatg

SEQ ID NO: 395 - DNA, 25 bp, Artificial Sequence
  Probe Sequence
tacgtgatcctaaactctggcctga

SEQ ID NO: 396 - DNA, 25 bp, Artificial Sequence
  Probe Sequence
ctgatcctgatactttcgatccaga

SEQ ID NO: 397 - DNA, 25 bp, Artificial Sequence
  Probe Sequence
gactttcgtggtcagtactataagt

SEQ ID NO: 398 - DNA, 25 bp, Artificial Sequence
  Probe Sequence
tggtcagtactataagtatatcccg

SEQ ID NO: 399 - DNA, 25 bp, Artificial Sequence
  Probe Sequence
gaattgaattttggtctgatcgtga

SEQ ID NO: 400 - DNA, 25 bp, Artificial Sequence
  Probe Sequence
tggtctgatcgtgaagatgatcgct

SEQ ID NO: 401 - DNA, 25 bp, Artificial Sequence
  Probe Sequence
atcgtgaagatgatcgctggaaaaa

SEQ ID NO: 402 - DNA, 25 bp, Artificial Sequence
  Probe Sequence
gatgatcgctggaaaaaattatgaa

SEQ ID NO: 403 - DNA, 25 bp, Artificial Sequence
  Probe Sequence
tatgaatccggtaaaggagatgaac

SEQ ID NO: 404 - DNA, 25 bp, Artificial Sequence
  Probe Sequence
tccggtaaaggagatgaacaagtgg

SEQ ID NO: 405 - DNA, 25 bp, Artificial Sequence
  Probe Sequence
aacaagtggagagatttaagaaagc

SEQ ID NO: 406 - DNA, 25 bp, Artificial Sequence
  Probe Sequence
gattttatcaatggagtttgtgtta

SEQ ID NO: 407 - DNA, 25 bp, Artificial Sequence
  Probe Sequence
ttatgggatgcatttccaattccat

SEQ ID NO: 408 - DNA, 25 bp, Artificial Sequence
  Probe Sequence
tgggatgcatttccaattccattat

SEQ ID NO: 409 - DNA, 25 bp, Artificial Sequence
  Probe Sequence
ggatgcatttccaattccattattt

SEQ ID NO: 410 - DNA, 25 bp, Artificial Sequence
  Probe Sequence
gatgcatttccaattccattattta

SEQ ID NO: 411 - DNA, 25 bp, Artificial Sequence
  Probe Sequence
tgcatttccaattccattatttaaa

SEQ ID NO: 412 - DNA, 25 bp, Artificial Sequence
  Probe Sequence
cattatttaaatgggtggattttca

SEQ ID NO: 413 - DNA, 25 bp, Artificial Sequence
  Probe Sequence
attttcaagggcatgttaaggctat

SEQ ID NO: 414 - DNA, 25 bp, Artificial Sequence
  Probe Sequence
caagggcatgttaaggctatgaaaa

SEQ ID NO: 415 - DNA, 25 bp, Artificial Sequence
  Probe Sequence
tgttaaggctatgaaaaggactttt

SEQ ID NO: 416 - DNA, 25 bp, Artificial Sequence
  Probe Sequence
aaggttactctcgtgatactgtcat

SEQ ID NO: 417 - DNA, 25 bp, Artificial Sequence
  Probe Sequence
gcagacacagttgctcttcacataa

SEQ ID NO: 418 - DNA, 25 bp, Artificial Sequence
  Probe Sequence
gttacgattatatccaccaggacct

SEQ ID NO: 419 - DNA, 25 bp, Artificial Sequence
  Probe Sequence
ccaggacctttgttagtaccacacg

SEQ ID NO: 420 - DNA, 25 bp, Artificial Sequence
  Probe Sequence
cctttgttagtaccacacgaaaatg

SEQ ID NO: 421 - DNA, 25 bp, Artificial Sequence
  Probe Sequence
aactctggtctgatcctgatacttt

SEQ ID NO: 422 - DNA, 25 bp, Artificial Sequence
  Probe Sequence
gactttcgtggtcagtactataagt

SEQ ID NO: 423 - DNA, 25 bp, Artificial Sequence
  Probe Sequence
tggtcagtactataagtatatcccg

SEQ ID NO: 424 - DNA, 25 bp, Artificial Sequence
  Probe Sequence
gatccaaggtttcaattacagaact

SEQ ID NO: 425 - DNA, 25 bp, Artificial Sequence
  Probe Sequence
gtgcaggcataactatacgtaaggt

SEQ ID NO: 426 - DNA, 25 bp, Artificial Sequence
  Probe Sequence
aatcctgtggaactgataatagcgc

SEQ ID NO: 427 - DNA, 25 bp, Artificial Sequence
  Probe Sequence
atcctgtggaactgataatagcgcc

SEQ ID NO: 428 - DNA, 25 bp, Artificial Sequence
  Probe Sequence
cctgtggaactgataatagcgcctc

SEQ ID NO: 429 - DNA, 25 bp, Artificial Sequence
  Probe Sequence
tgtggaactgataatagcgcctcgc

SEQ ID NO: 430 - DNA, 25 bp, Artificial Sequence
  Probe Sequence
ggaactgataatagcgcctcgcctg

SEQ ID NO: 431 - DNA, 25 bp, Artificial Sequence
  Probe Sequence
gaactgataatagcgcctcgcctgg

SEQ ID NO: 432 - DNA, 25 bp, Artificial Sequence
  Probe Sequence
actgataatagcgcctcgcctggca

SEQ ID NO: 433 - DNA, 25 bp, Artificial Sequence
  Probe Sequence
tcgcctggcacctgagctttattaa

SEQ ID NO: 434 - DNA, 393 bp, Nicotiana tabacum
gtttttcccatagaagcctttgtaggactagtaaccttcacatttctctcatacttcctatggacaaaaaaatctcaaaaacttccaaaacccttaccaccgaaaatccccggaggatggccggtaatcggccatctttttcacttcaataacgacggcgacgaccgtccattagctcgaaaactcggagacttagctgataaatacggccccgttttcacttttcggctaggtcttccccttgtgctagttgtaagcagttacgaagctataaaagattgcttctctacaaatgacgccattttctccaatcgtccagcttttctttacggcgaataccttggctacaataatacaatgctttttctagcaaattacggaccttactggcga

SEQ ID NO: 435 - DNA, 479 bp, Nicotiana tabacum
tagtatacctccaagctattgttaaaaaggtgttacgattatatccaccaggacctttgttagtaccacatgaaaatgtaaaggattgtgttgttagtggatatcacattcctaaagggactagattattcgcaaacgtcatgaaactgcagcgcgatcctaaattcttgtcaaatcctgataagttcgatccagagagattcatcgctggtgatattgacttccgtggtcaccactatgagtttatcccatttggttctggaagacgatcttgtccggggatgacttatgcatcgcaagtggaacacctaacaatggcacatttagtccagggtttcaattacaaaactccaaatgacgaggccttggatatgaaggaaggtgcaggcataacaatacgtaaggtaaatccagtggaattgatagtaacgcctcgcttggcacctgagctttactaaacctaagatctttcatcttgg

SEQ ID NO: 436 - protein, 151 aa, Nicotiana tabacum
VYLQAIVKKVLRLYPPGPLLVPHENVKDCVVSGYHIPKGTRLFANVMKLQRDPKFLSNPDKFDPERFIAGDIDFRGHHYEFIPFGSGRRSCPGMTYASQVEHLTMAHLVQGFNYKTPNDEALDMKEGAGITIRKVNPVELIVTPRLAPELY

SEQ ID NO: 437 - DNA, 512 bp, Nicotiana tabacum
ggatagatgggtagaagagagtgatattaaggatttggtgtacctccaagctattgtcaaagaagtgttacgattgtatccaccaggacctttgttagtaccacatgaaaatgtggaggattgtgttgttagtggatatcacattcctaaagggactagactatttgcgaatgtcatgaaactgtaacgcgatcctaaactctggccaaatcctgataatttcgatccagagagattcatcgctgcagatattgacttccgtggtcagcactatgagtatatcccgtttggttctggaagacgatcttgtccggggatgacttatgcattgcaagcggaacatctaacaatggcacatttgatccaaggtttcaattacaggactccaactaacgagcccttggatatgaaggaaggtgcaggcataactatacgtaaggtaaatcctgtggaagtgctaattaagcctcgcctggcacccgagctttattaaaacctaagatcatcttgct

SEQ ID NO: 438 - protein, 61 aa, Nicotiana tabacum
DRWVEESDIKDLVYLQAIVKEVLRLYPPGPLLVPHENVEDCVVSGYHIPKGTRLFANVMKL

SEQ ID NO: 439 - DNA, 503 bp, Nicotiana tabacum
aggatagatgggtagaagagagtgatattaaggatttggtgtacctccaagctattgtcaaagaagtgttacgattgtatccaccaggacctttgttagtaccacatgaaaatgtagaggattgtgttgttagtggatatcacattcctaaagggactagactatttgcgaatgtcatgaaactgcaacgcgatcctaaactctggccaaatcctgataatttcgatccagagagattcgtcgctgcagatattgacttccgtggtcagcactatgagtatatcccgtttggttctggaagacgatcttgtccgggggtgacttatgcattgcaagtggaacatcacatttgatccaaggtttcaattacaggactccaactaacgagcccttggatatgaaggaaggtgcacgcataactatacgtaaggtaaatcctgtggaagtgctaattaagcctagcctggcacctgagctttattaaaacctaagatcatcttgct

SEQ ID NO: 440 - protein, 68 aa, Nicotiana tabacum
VYPVWFWKTILSGGDLCIASGTSHLIQGFNYRTPTNEPLDMKEGARITIRKVNPVEVLIKPSLAPELY

SEQ ID NO: 441 - DNA, 410 bp, Nicotiana tabacum
ctgaaatagagggagtataatattcatttcaagagatcactataaaaaggaagttcgtgatagtttgattctcaagttcttatctaaaaatccataatggtttttcccatagaagccattgtaggactagtaaccttcacatttctcttatacttcctatggacaaaaaaatctcaaaaacctccaaaacccttaccaccgaaaatccccggaggatggccggtaatcggccatcttttctacttcgataacgaaggcgacgaccgtccattagctcggagacttagctgataaatacggccccgttttcacttttcggctaggtcttccccttgtgctagttgtaagcagttatgaagctataaaagattgcttctctacaaatgacgccattttctccaatcgtccag

SEQ ID NO: 442 - protein, 60 aa, Nicotiana tabacum
MVFPIEAIVGLVTFTFLLYFLWTKKSQKPPKPLPPKIPGGWPVIGHLFYFDNEGDDRPLA

SEQ ID NO: 443 - DNA, 421 bp, Nicotiana tabacum
ggacctttgttagtaccacatgaaaatgtaaaggattgtgttgttagtggatatcacattcctaaagggactagattattcgcaaacgtcatgaaactgcagcgcgatcctaaattcttgtcaaatcctgataagttcgatccagagagattcatcgctggtgatattgacttccgtggtcaccactatgagtttatcccatttggtcctggaagacgatcttgtccggggatgacttatgcattgcaagtggaacacctaacaatggcacatttaatccagggtttcaattacaaaactccaaatgacgagcccttggatatgaaggaaggtgcaggcataactatacgtaaggtaaatcctgtggaactgataatagcgcctcgcctggcacctgagctttattaaaacctaagatcat

SEQ ID NO: 444 - protein, 135 aa, Nicotiana tabacum
GPLLVPHENVKDCVVSGYHIPKGTRLFANVMKLQRDPKFLSNPDKFDPERFIAGDIDFRGHHYEFIPFGPGRRSCPGMTYALQVEHLTMAHLIQGFNYKTPNDEPLDMKEGAGITIRKVNPVELIIAPRLAPELY

SEQ ID NO: 445 - DNA, 577 bp, Nicotiana tabacum
atgacattattgataaacaatcaaaatgccttgatgaaagcacaagaagagatagacacaaaagttggtaaggatagatgggtagaagagagtgatattaaggatttagtatacctccaagctattgttaaaaaggtgttacgattatatccaccaggacctttgttagtaccacatgaaaatgtaaaggattgtgttgttagtggatatcacattcctaaagggactagattattcgcaaacgtcatgaaactgcagcgcgatcctaaactcttgtcaaatcctgataagttcgatccagagagattcatcgctggtgatattgacttccgtggtcaccactatgagtttatcccatttggttctggaagacgatcttgtccggggatgacttatgcattgcaagtggaacacctaacaatggcacatttaatccagggtttcaattacaagactccaaatggcgaggccttggatatgaaggaaggtgcaggcataacaatacgtaaggtaaatccagtggaattgataatagcgcctcgcctggcacctgagctttattaatacctaagatcat

SEQ ID NO: 446 - protein, 187 aa, Nicotiana tabacum
MTLLINNQNALMKAQEEIDTKVGKDRWVEESDIKDLVYLQAIVKKVLRLYPPGPLLVPHENVKDCVVSGYHIPKGTRLFANVMKLQRDPKLLSNPDKFDPERFIAGDIDFRGHHYEFIPFGSGRRSCPGMTYALQVEHLTMAHLIQGFNYKTPNGEALDMKEGAGITIRKVNPVELIIAPRLAPELY

SEQ ID NO: 447 - DNA, 381 bp, Nicotiana tabacum
ggatatcacattcctaaagggactagattattcgcaaacgtcatgaaactgcagcgcgatcctaaactcttgtcaaatcctgataagttcgatccagagagattcatcgctggtgatattgacttccgtggtcaccactatgagtttatcccatttggttctggaagacgatcttgtccggggatgacttatgcattgcaagtggaacacctaacaatggcacatttaatccagggtttcaattacaaaactccaaatgacgaggccttggatatgaaggaaggtgcaggcataacaatacgtaaggtaaatccagtggaattgataataacgcctcgcttggcacctgagctttattaaaacctaagatcatcttgcttg

SEQ ID NO: 448 - protein, 119 aa, Nicotiana tabacum
GYHIPKGTRLFANVMKLQRDPKLLSNPDKFDPERFIAGDIDFRGHHYEFIPFGSGRRSCPGMTYALQVEHLTMAHLIQGFNYKTPNDEALDMKEGAGITIRKVNPVELIITPRLAPELY

SEQ ID NO: 449 - DNA, 444 bp, Nicotiana tabacum
cgattatatccaccgggacctttattagtaccccatgaaaatgtagaggattgtgttgttagtggatatcacattcctaaagggactagactattcgcgaacgttatgaaattacagcgcgatcctaaactctggtcaaatcctgataagttcgatccagagagatttttcgctgctgatattgactttcgtggtcaacactatgagtttatcccatttggttctggaagacgatcttgtccggggatgacttatgctatgcaagtggaacacctaacaatcgcacacttgatccagggtttcaattacaaaactccaaatgacgagcccttggatatgaaggaaggtgcaggattaactatacgtaaggtaaatcctatagaagtggtaattacgcctcgcctgacacctgagctttattaaaacctaagatcatcttgcttg

SEQ ID NO: 450 - protein, 140 aa, Nicotiana tabacum
RLYPPGPLLVPHENVEDCVVSGYHIPKGTRLFANVMKLQRDPKLWSNPDKFDPERFFAADIDFRGQHYEFIPFGSGRRSCPGMTYAMQVEHLTIAHLIQGFNYKTPNDEPLDMKEGAGLTIRKVNPIEVVITPRLTPELY

SEQ ID NO: 451 - DNA, 379 bp, Nicotiana tabacum
atatcacattcctaaagggactagattattcgcaaacgtcatgaaactgcagcgcgatcctaaactcttgtcaaatcctgataagttcgatccagagagattcatcgctggtgatattgacttccgtggtcaccactatgagtttatcccatttggttctggaagacgatcttgtccggggatgacttatgcattgcaagtggaacacctaacaatggcacatttaatccagggtttcaattacaaaactccaaatgacgaggccttggatatgaaggaaggtgcaggcataacaatacgtaaggtaaatccagtggaattgataataacgcctcgcttggcacctgagctttattaaaacctaagatcatcttgcttg

SEQ ID NO: 452 - protein, 118 aa, Nicotiana tabacum
YHIPKGTRLFANVMKLQRDPKLLSNPDKFDPERFIAGDIDFRGHHYEFIPFGSGRRSCPGMTYALQVEHLTMAHLIQGFNYKTPNDEALDMKEGAGITIRKVNPVELIITPRLAPELY

SEQ ID NO: 453 - DNA, 440 bp, Nicotiana tabacum
gtgatactgtcataaaagcaacagtgtttagtttagtcttggatgctgcggacacagttgctcttcacatgaattggggaatggcattattgataaacaatcaacatgccttgaagaaagcgcaagaagagatagataaaaaagttggtaaggatagatgggtagaagagagtgatattaaggatttggtatacctccaaactattgttaaagaagtgttacgattatatccaccgggacctttattagtaccccatgaaaatgtagaggattgtgttgttagtggatatcacattcctaaagggactagactattcgcgaacgttatgaaattacagcgcgatcctaaactctggtcaaatcctgataagttcgatccagagagatttttcgctgctgatattgactttcgtggtcaacactatgagtttatcccattt

SEQ ID NO: 454 - protein, 146 aa, Nicotiana tabacum
DTVIKATVFSLVLDAADTVALHMNWGMALLINNQHALKKAQEEIDKKVGKDRWVEESDIKDLVYLQTIVKEVLRLYPPGPLLVPHENVEDCVVSGYHIPKGTRLFANVMKLQRDPKLWSNPDKFDPERFFAADIDFRGQHYEFIPF

SEQ ID NO: 455 - DNA, 386 bp, Nicotiana tabacum
ataatgctttctcccatagaagccattgtaggagcagtaaccctaattacatttctcttatacttcctatgtacaaaagaatctcaaaaacattcaaagcccttaccaacgaaaatccccggaggatggccggtaatcggccatcttttccacttcaataacgacggcgacgaccgtccattagctcgaaaactcggagacttagctgataaatacggccccgttttcacttttcggctaggtcttccccttgtgctagttgtaagcagttacgaagctttaaaagattgcttctctacaaatgacgccattttctccaatcgtccagcttttctttacggcgaataccttggctacaataatacaatgctttttctagcaaatta

SEQ ID NO: 456 - protein, 127 aa, Nicotiana tabacum
MLSPIEAIVGAVTLITFLLYFLCTKESQKHSKPLPTKIPGGWPVIGHLFHFNNDGDDRPLARKLGDLADKYGPVFTFRLGLPLVLVVSSYEALKDCFSTNDAIFSNRPAFLYGEYLGYNNTMLFLAN

SEQ ID NO: 457 - DNA, 552 bp, Nicotiana tabacum
agaaagcacaagaagagatagacacaaaagttggcaaggatagatgggtagaagagagtgatattaaggatttggtgtacctccaagctattgttaaagaagtgttacgattatatccaccgggacctttgttagtaccacatgaaaatatagaggattgtgttgttagtggatattacatttctaaagggactagactattcgcaaatgttatgaaactgcagcgcgatcctaaactctggccaaatcctgataatttcgatccagagagatttgtcgctgcaggtattgactttcgtggtcagcattatgagtatatcccgtttggttctggaagacgatcttgtccggggatgacttatgcattgcaagtggaacacttaacaatggcacatttgatccagggtttcaattacagcactccaaatgacgagcccttggatatgaaggaaggtgcaggtataactatacgtaaggtaaatcccgtggaagtgataattatgcctcgcctggcacctgagctttattaaaacctaagatctttcatcttgg

SEQ ID NO: 458 - protein, 175 aa, Nicotiana tabacum
KAQEEIDTKVGKDRWVEESDIKDLVYLQAIVKEVLRLYPPGPLLVPHENIEDCVVSGYYISKGTRLFANVMKLQRDPKLWPNPDNFDPERFVAAGIDFRGQHYEYIPFGSGRRSCPGMTYALQVEHLTMAHLIQGFNYSTPNDEPLDMKEGAGITIRKVNPVEVIIMPRLAPELY

SEQ ID NO: 459 - DNA, 609 bp, Nicotiana tabacum
ataatgctttctcccatagaagccattgtaggactagtaaccttcacatttctcttctacttcctatggacaaaaaaatctcaaaaaccttcaaaacccttaccaccgaaaatccccggaggatggccggtaattggccatcttttccacttcaatgacgacggcaacgaccgtccattagctcgaaaactcggagacttagctgacaaatacggccccgttttcacttttcggctaggccttccccttgtgttagttgtaagcagttacgaagctataaaagactgtttctctacaaatgatgccattttctctaatcgtccagcttttctttacggcgaataccttggctacaataatgccatgctatttttggcaaattacggaccttactggcgaaaaaatcgtaaattagttattcaggaagttctctcagctagtcgtctcaaaaaattcaaacacgtgagattcgccagaattcaaacgagcattaagaatttatacactcgaattgatagaaattcgagtacgataaatttaactgattggttagaagaattgaattttggtctcatcgtgaagatgatagctgggaaaaattatgattcc

SEQ ID NO: 460 - protein, 202 aa, Nicotiana tabacum
MLSPIEAIVGLVTFTFLFYFLWTKKSQKPSKPLPPKIPGGWPVIGHLFHFNDDGNDRPLARKLGDLADKYGPVFTFRLGLPLVLVVSSYEAIKDCFSTNDAIFSNRPAFLYGEYLGYNNAMLFLANYGPYWRKNRKLVIQEVLSASRLKKFKHVRFARIQTSIKNLYTRIDRNSSTINLTDWLEELNFGLIVKMIAGKNYDS

SEQ ID NO: 461 - DNA, 1277 bp, Nicotiana tabacum
ttgatttacatgtttggtcaagaacataaagaccatcgccgtcgaatggcccctaattttacccctaaagctcttgctacttacactgttatccaacaaaagattattatcaaacactttcagtcctggttggacgaagcatcccaatcccctaacaaaccaatcacacttcgcctcctttgccgcgatatgaacttggatacttcccagactgtcttcgttggtccatacttaaacgaagattccagaaagcagttcaatgttgactacaattacttcaatgttgggttaatgaaactccctgttgatttacctggtttcgccttcagagatgctaggttagctgttgggagactagtcgacacgctttccgtttgtgcagcacagagccaaattaagatgcgaggtgacgaagaacccacttgcttgattgatttttggatgcaggagaatttcagagagattcaggaagctaagattaatggttcacaaaagccgtttgagtataccagtaagcaacttggtggcttcttatttgacttcctctttgcggctcaagatgcttctacttcatctctgttatgggcaatggtgcttttggaatctcacccgcaagttctggagagagtccgagccgaagtggcgaaattctggtcgccagaatctgaggagcagccgttgacggcggagatgcttagggaaatgaagtacctggaggcggtggcgcgtgaggttgttaggatcagaactccggcggctttggtgccgcacattgccggcgaagaattccggttaactgatgattatgttattccaaaggggactattgttttcccttcggtttttgactcgtctttccaggggtttcctgaaccggagaagtttgacccggaccggttcacagaggagaggcaagaggaacgggtttacaagaagaattatctagcatttggagctgggccccatggatgtgtgggacagaggtatgctataaaccatttgatgctctttattgcgttgttcacggctctgattgatttcaagaggcacaaaacggacggctgtgatgatatcgcgtatattccaaccattgctccaaaggatgattgtaaagtgttcctttcacagaggtgcactcgattcccatctttttcatgaactaattgcaccttttatttaattctgatcctcaaattggtcccattggaccatggatgtaataggaccaattgcaagaatggggtccaatgtatttgttctttccatttatttttttt

SEQ ID NO: 462 - protein, 385 aa, Nicotiana tabacum
LIYMFGQEHKDHRRRMAPNFTPKALATYTVIQQKIIIKHFQSWLDEASQSPNKPITLRLLCRDMNLDTSQTVFVGPYLNEDSRKQFNVDYNYFNVGLMKLPVDLPGFAFRDARLAVGRLVDTLSVCAAQSQIKMRGDEEPTCLIDFWMQENFREIQEAKINGSQKPFEYTSKQLGGFLFDFLFAAQDASTSSLLWAMVLLESHPQVLERVRAEVAKFWSPESEEQPLTAEMLREMKYLEAVAREVVRIRTPAALVPHIAGEEFRLTDDYVIPKGTIVFPSVFDSSFQGFPEPEKFDPDRFTEERQEERVYKKNYLAFGAGPHGCVGQRYAINHLMLFIALFTALIDFKRHKTDGCDDIAYIPTIAPKDDCKVFLSQRCTRFPSFS

SEQ ID NO: 463 - DNA, 1204 bp, Nicotiana tabacum
tcattttcagtatgctatgttttgtctacttgtgttgatgtgtttcggggataagctcgacgaggctcaaatcaaacaaattgaaggtgttcagcgcaggttgctcctgggtttccgacgattcaatatactcaatttcttacccagagttgggaaaataatctttaggaatcgctggaaggaactaattgaactacgtcaagagcaagagaagatcttcattcctttgattgaagctcgaagtattagggccaaagaacaaaagcctgaggaagaagtggtggcttatgtggatacgctgttgaatttggaattgccaggggaaaacaggagcctcaattatggggaaatggttagcctctgcagtgaattcctaaacgccggaactgatacgacgtccaccgccttacagtgggttatggccaacttggtcaaaaacccttccattcagggaaaactatatcaagaaattgctagtgtagtgggagagaaacagagcaagttgacagaagaggtggtaaaggaggacgatctgcataaaatgccatacttgagagcagtgatctttcttaggcgacacccgcctggtcactttgtgctgccacatacggtgacagaggaagtagaactgaatggctatgttgtcccgaagaatgccaccatcaatttcatggttgcagacatgggtttggacccaaaggtgtgggaggatcccttggaattcaagccagagaggttcttaatggagggatcagataaggaagggttcgatataacaggaagtagagagatcaagatgatgccatttggcgctggtaggagaatttgcccaggctatgctttggctatgcttcatctagagtactttgtggctaatttggtttggcattttcgatgggaggctgtggagggagatgatgttgatctttcagaaaagctagaattcaccgttgtgatgaagaatccacttcgagctcgtatctgcctcagagttaactctatttgaatttggtaattactagttctttctatttgcattgttccctgttgatggacttcccccatatagtactggaagttagagggagaatgattattaatgccttgctgcaatattagcttagtagttagtagtgaatataattgaaactggatatttctatcttatgtgttgtacatttggttcattgcaaagggcgaattc

SEQ ID NO: 464 - protein, 334 aa, Nicotiana tabacum
HFQYAMFCLLVLMCFGDKLDEAQIKQIEGVQRRLLLGFRRFNILNFLPRVGKIIFRNRWKELIELRQEQEKIFIPLIEARSIRAKEQKPEEEVVAYVDTLLNLELPGENRSLNYGEMVSLCSEFLNAGTDTTSTALQWVMANLVKNPSIQGKLYQEIASVVGEKQSKLTEEVVKEDDLHKMPYLRAVIFLRRHPPGHFVLPHTVTEEVELNGYVVPKNATINFMVADMGLDPKVWEDPLEFKPERFLMEGSDKEGFDITGSREIKMMPFGAGRRICPGYALAMLHLEYFVANLVWHFRWEAVEGDDVDLSEKLEFTVVMKNPLRARICLRVNSI

SEQ ID NO: 465 - DNA, 1066 bp, Nicotiana tabacum
ataaatctaactgattggttagaagaattgaattttggtctgatcgtgaaaatgatcgctgggaaaaattatgaatccggtaaaggagatgaacaagtggaaagatttaagaatgcgtttaaggatttcatggttttatcaatggaatttgtattatgggatgcatttccaattccattatttaaatgggtggattttcaaggtcatattaaggcaatgaaaaggacatttaaggatatagattctgtttttcagaactggttagaggaacatattaataaaagagaaaaaatggaggttaatgcagaagggaatgaacaagatttcattgatgtggtgctttcaaaaatgagtaatgaatatcttggtgaaggttactctcgtgatactgtcattaaagcaacggtgtttagtttggtcttggatgcagcagacacagttgctcttcacataaattggggaatggcattattgataaacaatcaaaaggccttgacgaaagcacaagaagagatagacacaaaagttggtaaggacagatgggtagaagagagtgatattaaggatttggtatacctccaagctattgttaaagaagtgttacgattatatccaccaggacctttgttagtaccacacgaaaatgtagaagattgtgttgttagtggatatcacattcctaaagggacaagattattcgcaaacgtcatgaaactgcaacgtgatcctaaactctggtctgatcctgatactttcgatccagagagattcattgctactgatattgactttcgtggtcagtactataagtatatcccgtttggttctggaagacgatcttgtccagggatgacttatgcattgcaagtggaacacttaacaatggcacatttgatccaaggtttcaattacagaactccaaatgacgagcccttggatatgaaggaaggtgcaggcataactatacgtaaggtaaatcctgtggaactgataataacgcctcgcctggcacctgagctttattaaaacctaagatgtttcatcttggttgatcattgtttaatac

SEQ ID NO: 466 - protein, 341 aa, Nicotiana tabacum
INLTDWLEELNFGLIVKMIAGKNYESGKGDEQVERFKNAFKDFMVLSMEFVLWDAFPIPLFKWVDFQGHIKAMKRTFKDIDSVFQNWLEEHINKREKMEVNAEGNEQDFIDVVLSKMSNEYLGEGYSRDTVIKATVFSLVLDAADTVALHINWGMALLINNQKALTKAQEEIDTKVGKDRWVEESDIKDLVYLQAIVKEVLRLYPPGPLLVPHENVEDCVVSGYHIPKGTRLFANVMKLQRDPKLWSDPDTFDPERFIATDIDFRGQYYKYIPFGSGRRSCPGMTYALQVEHLTMAHLIQGFNYRTPNDEPLDMKEGAGITIRKVNPVELIITPRLAPELY

SEQ ID NO: 467 - DNA, 994 bp, Nicotiana tabacum
atgagaatggtagctggaaagagatattatggtgaagaggtagataacgaggaggcaaaccattttcgggagcttgtagaagaggttatttcatatgggggtgcatcaaatcccacggatttcatgcctgcaatatttcgttgctttttcaggagtatggagaagaatttggccaggcttggtagcaaaatggacgcgctcttgcaaggcttgattgatgaacaccgtcgtgataaaagcagaaattccatgattgatcatttgctttctctgcaagaatcagaaccagaatattactctgatcaaatcatcaaaggaataatattggtcatgctgaatgcggggactgaaacatcatctgtaacaatagaatgggcaatgtctcttttactcaatcatccagaggtgttggaaaaggccaaagctgaaatagacgaccatgtgggtaaagatcgtttagtggatgaagcagatttacccaagctgaaataccttcaaagtattatttcagagacacttcgattgtaccctgcaggaccaatgctagtgcctcatggatcatctgatgattgcactatcgctgggttgcacattccacgtggcacgatgctattggtgaatgcttgggccatccacagggacccattactttgggaggatccagagagcttcaagccagaaaggtttgaaggtgtgcaagtggaatcatggaagctattgccatttggaatgggaaggagagcgtgtccaggttctggacttgctcaacgtgtggttggtttagctttagcatctctagtgcagtgttttgagtggaaaagggtaagtgaagaggtggttgatttgactgaaggaaaaggtctcaccatgccaaaagctgagccactcatggctaggtgcgaagctcgtgatattcttcacaaagttgtttcagaaatatcctaacgtttcagagtgtttcttgcatttttttagtgctccatacctctagttt

SEQ ID NO: 468 - protein, 314 aa, Nicotiana tabacum
MRMVAGKRYYGEEVDNEEANHFRELVEEVISYGGASNPTDFMPAIFRCFFRSMEKNLARLGSKMDALLQGLIDEHRRDKSRNSMIDHLLSLQESEPEYYSDQIIKGIILVMLNAGTETSSVTIEWAMSLLLNHPEVLEKAKAEIDDHVGKDRLVDEADLPKLKYLQSIISETLRLYPAGPMLVPHGSSDDCTIAGLHIPRGTMLLVNAWAIHRDPLLWEDPESFKPERFEGVQVESWKLLPFGMGRRACPGSGLAQRVVGLALASLVQCFEWKRVSEEVVDLTEGKGLTMPKAEPLMARCEARDILHKVVSEIS

SEQ ID NO: 469 - DNA, 1030 bp, Nicotiana tabacum
ctcctttgccgcgatatgaacttggatacttcccagactgtcttcgttggtccatacttaaacgaagattccagaaagcagttcaatgttgactacaattacttcaatgttgggttaatgaaactccctgttgatttacctggtttcgccttcagagatgctaggttagctgttgggagactagtcgacacgctttccgtttgtgcagcacagagccaaattaagatgcgaggtgacgaagaacccacttgcttgattgatttttggatgcaggagaatttcagagagattcaggaagctaagattaatggttcacaaaagccgtttgagtataccagtaagcaacttggtggcttcttatttgacttcctctttgcggctcaagatgcttctacttcatctctgttatgggcaatggtgcttttggaatctcacccgcaagttctggagagagtccgagccgaagtggcgaaattctggtcgccagaatctgagcagccgttgacggcggagatgcttagggaaatgaagtacctggaggcggtggcgcgtgaggttgttaggatcagaactccggcgactttggtgccgcacattgccggcgaagaattccggttaactgatgattatgttattccaaaggggactattgttttcccttcggtttttgactcgtctttccaggggtttcctgaaccggagaagtttgacccggaccggttcacagaggagaggcaagaggaacgggtttacaagaagaattatctagcatttggagctgggccccatggatgtgtgggacagaggtatgctataaaccatttgatgctctttattgcgttgttcacggctctgattgatttcaagaggcacaaaacggacggctgtgatgatatcgcgtatattccaaccattgctccaaaggatgattgtaaagtgttcctttcacagaggtgcactcgattcccatctttttcatgaactaattgcgccttttatttaattctgatcctcaaattggtcccattgg

SEQ ID NO: 470 - protein, 326 aa, Nicotiana tabacum
LLCRDMNLDTSQTVFVGPYLNEDSRKQFNVDYNYFNVGLMKLPVDLPGFAFRDARLAVGRLVDTLSVCAAQSQIKMRGDEEPTCLIDFWMQENFREIQEAKINGSQKPFEYTSKQLGGFLFDFLFAAQDASTSSLLWAMVLLESHPQVLERVRAEVAKFWSPESEQPLTAEMLREMKYLEAVAREVVRIRTPATLVPHIAGEEFRLTDDYVIPKGTIVFPSVFDSSFQGFPEPEKFDPDRFTEERQEERVYKKNYLAFGAGPHGCVGQRYAINHLMLFIALFTALIDFKRHKTDGCDDIAYIPTIAPKDDCKVFLSQRCTRFPSFS

SEQ ID NO: 471 - DNA, 593 bp, Nicotiana tabacum
  misc_feature (80)..(80): n = a,t c, or g
gatcgtttagtggatgaagcagatttacccaagctgaaataccttcaaagtattatttcagagacacttcgattgtaccntgcagcaccaatgctagtgcctcatgaatcatctgatgattgcacggtcgctggcttccacattcctcgtggcacgatgctattggtgaatgcttgggccatccacagggaccccttactttgggaggacccagagagcttcaagccaaaaaggtttgaaggtgtgcaagccgaatcatggaagctattgccatttggaatgggaaggagagcgtgcccaggttctggacttgctcaatgtgtggttggtttagctttagcaactctagtgcagtgttttgagtggaaaagggtaagcgaagaggtggttgatttgacggaaggaaaaggtctcactatgccaaaacccgagccactcatggctaggtgcgaagctcgtgacatttttcacaaagttctttcagaaatatcttaatgttttgggagtctgaattaataatgtaaaatgtattttcattttctcatataatattgcactatctacatttctgatatgtcattgagatactccgg

SEQ ID NO: 472 - protein, 164 aa, Nicotiana tabacum
  VARIANT (27)..(27): Xaa = Leu, Pro, His, or Arg.
DRLVDEADLPKLKYLQSIISETLRLYXAAPMLVPHESSDDCTVAGFHIPRGTMLLVNAWAIHRDPLLWEDPESFKPKRFEGVQAESWKLLPFGMGRRACPGSGLAQCVVGLALATLVQCFEWKRVSEEVVDLTEGKGLTMPKPEPLMARCEARDIFHKVLSEIS

SEQ ID NO: 473 - DNA, 571 bp, Nicotiana tabacum
gaggacgatctgcataaaatgccatacttgagagcagtgatcttagagggtcttaggcgacacccgcctggtcactttgtgctgccacatacggtgacagaggaagtagaactgaatggctatgttgtcccgaagaatgccaccatcaatttcatggttgcagacatgggtttggacccaaaggtgtgggaggatcccttggaattcaagccagagaggttcttaatggagggatcagataaggaagggttcgatataacaggaagtagagagatcaagatgatgccatttggcgctggtaggagaatttgcccaggctatgctttggctatgcttcatctagagtactttgtggctaatttggtttggcattttcgatgggaggctgtggagggagatgatgttgatctttcagaaaagctagaattcaccgttgtgatgaagaatccacttcgagctcgtatctgcctcagagttaactctatttgaatttggtaattactagttctttctatttgcattgttccctgttgatggacttcccccatatagtactggaagttagagggag

SEQ ID NO: 474 - protein, 162 aa, Nicotiana tabacum
EDDLHKMPYLRAVILEGLRRHPPGHFVLPHTVTEEVELNGYVVPKNATINFMVADMGLDPKVWEDPLEFKPERFLMEGSDKEGFDITGSREIKMMPFGAGRRICPGYALAMLHLEYFVANLVWHFRWEAVEGDDVDLSEKLEFTVVMKNPLRARICLRVNSI

SEQ ID NO: 475 - DNA, 1294 bp, Nicotiana tabacum
gcagtgctgacttggcgtacgaagctttaattgaaaagggtcaaattttcgctacccgcccgagtgagaccccgacccgaaccattttcagttgcaacaagttcagtgtcaatgcagcaatttacgggccactttggcgatccctgagaagaaatatggtccaaaatatgcttagttcgagtagagtgaaagaatttcgtgattgtagagaaatggcaatggataagttgattgaaaggatacatgcagatgctaaggccaataacgatatcgtttgggtgctgaaaaacgcgcgtttcgcggtgttttatatacttttgactatgtgttttggtgttgaaatggatgagaaaatgattgaaaccgttgatcaaatgatgaaggatgtgctaatggagcttcatccaagaatagatgattttcttcctatattgagcttgtttgttggttataaacaacgtaagagagttcacgaagttcgcaagagacaaatagaaacacttgtccctttgatcgagaaacgtcgaagagcaatacaaaatcctgggtacgataagacagttgcctcgttttcgtacttagatactttatttgatgttaaggtcgaaggtacaaagtcaggaccaacgaatccggagcttgtaacactatgttcagagttcttgaatggtgggaccgacacaaccgctaccgcaatagagtgggccatagggagaatgatcgaaaatccaagcatacagaagagaatatacgaagagattagaaatacagtgggtgacagaaagattgacgaaaaggatatggataagatgccttatttaaacgccgttgtaaaggagcttttacgtaaacatcctcctacgtacgttacatttacccatgcagtaacggagccaacaacattgggtgggtatgacatacccacatatgctaatgtagagttttttgtacccgggatctcggatgacccgaaagtttggtctgatccggaaaagtttgacccggataggtttctatccgggcgggaggacgctgatataacgggtgtgaccggggtaaagatgatgccatttggggtcgggcggaggatttgtccgggcttgggcttggcaacggtgcatgtgaatttgatgttggcccgaatgattcaagaatttgaatggtccgcttacccggaaaataggaaagtggattttactgagaaattggaatttactgtggtgatgaaaaaccctttaagagctaaggtcaagccaagaatgcaagtggtgtaattcattaagattataagtcc

SEQ ID NO: 476 - protein, 423 aa, Nicotiana tabacum
SADLAYEALIEKGQIFATRPSETPTRTIFSCNKFSVNAAIYGPLWRSLRRNMVQNMLSSSRVKEFRDCREMAMDKLIERIHADAKANNDIVWVLKNARFAVFYILLTMCFGVEMDEKMIETVDQMMKDVLMELHPRIDDFLPILSLFVGYKQRKRVHEVRKRQIETLVPLIEKRRRAIQNPGYDKTVASFSYLDTLFDVKVEGTKSGPTNPELVTLCSEFLNGGTDTTATAIEWAIGRMIENPSIQKRIYEEIRNTVGDRKIDEKDMDKMPYLNAVVKELLRKHPPTYVTFTHAVTEPTTLGGYDIPTYANVEFFVPGISDDPKVWSDPEKFDPDRFLSGREDADITGVTGVKMMPFGVGRRICPGLGLATVHVNLMLARMIQEFEWSAYPENRKVDFTEKLEFTVVMKNPLRAKVKPRMQVV

SEQ ID NO: 477 - DNA, 1825 bp, Nicotiana tabacum
acagcatcttgtgctgccataataattactctagtggtgtgtatatggagagtgctgaattgggtttggttcagaccaaagaagctggaaaagctactgaggaaacaaggtctcaaaggcaattcctacaggattttgtatggggatatgaaggagctttctggtatgattaaggaagctaactccaaacccatgaatctttctgatgatattgccccaagattggtccctttctttcttgataccatcaagaaatatgggaaaaaatcctttgtatggttgggtccaaaaccgctggtttttgtcatggaccccgagcttataaaggaagtattctccaaaaactatctgtatcaaaagcctcattcaaatccattaaccaagttactggcacaaggacttgtaagccaagaggaagacaaatgggccaaacatagaaaaatcgtcactcctgccttccacctggagaagctaaaggtttgtaattgcaatggattctccgtaagcagttcatttttatcttttctttcatcgtaacagaaacttactcttgattgtgattcttttttgaggtacttgtttggaaccattttgtattcctaattacaaagtcggaacattttgaataagtgtcccttcattgactttctcttaaccatttcttaaacagcatatgcttccagctttttgtttgagctgtactgagatgctgagcaaatgggaagacattgttgcagttgagggctcacatgagatagatatatggcctggccttcaacaattaactagtgatgtgatctctcggacagcctttggcagtagctatgaagcaggtagaaggatatttgaacttcaaaaggaacaagctcaatttcttatggaagctatacgctccgtttatattccaggctggaggtttttgccaacaaagaggaacagaagaatgaaggaaattgaaaaggatgttcaagccttagttaaaggtattattgataaaagagtaaagtcaatgaaagcaggagaggtgaataatgaggatctgcttggtatattgctggaatctaattttaaagaaattgaacagcatggaaacaaggattttggaatgagcattgaagaagtcattcaagaatgcaagttattctattttgctggccaagaaactacatcagtgttgcttgtatggactctaatattgctgagcaggcatcaggattggcaagcactggccagagaagaggtgttgcaagtctttgggaatcagaaaccagattttgatggattaaatcgtctaaaaattgttacaatgatcttgtacgagtctttaaggctctatcccccagtagtgacacttacccgaaggcctaaggaagacactgtattaggagatgtatctctaccagcaggtgtgttaatctccttaccagtgatcttattgcatcacgacgaagagatatggggtaaagatgcaaagaagttcaagccagagagattcagagatggagtctcaagtgcaacaaagggtcaagtcacttttttcccatttacttggggtcccagaatatgcattggacaaaattttgccatgttagaagcaaagactactttggctatgatcctacaacgcttctcctttgaactgtctccatcttatgcacatgctcctcagtccataataactttgcaaccccagtatggtgctccacttattttgcataaaatatagtttattacttgtaagtagtgtctcgttttatgttaagcatgagtccaaaatgttaaggcttgtagaactgcaaaatgggaatgaatcactagtgaattc

SEQ ID NO: 478 - protein, 353 aa, Nicotiana tabacum
KQHMLPAFCLSCTEMLSKWEDIVAVEGSHEIDIWPGLQQLTSDVISRTAFGSSYEAGRRIFELQKEQAQFLMEAIRSVYIPGWRFLPTKRNRRMKEIEKDVQALVKGIIDKRVKSMKAGEVNNEDLLGILLESNFKEIEQHGNKDFGMSIEEVIQECKLFYFAGQETTSVLLVWTLILLSRHQDWQALAREEVLQVFGNQKPDFDGLNRLKIVTMILYESLRLYPPVVTLTRRPKEDTVLGDVSLPAGVLISLPVILLHHDEEIWGKDAKKFKPERFRDGVSSATKGQVTFFPFTWGPRICIGQNFAMLEAKTTLAMILQRFSFELSPSYAHAPQSIITLQPQYGAPLILHKI

SEQ ID NO: 479 - DNA, 920 bp, Nicotiana tabacum
catcaacgagcacaagaaaaatcttgcagctggcaagagtaatggtgcattaggaggtgaagatctaattgatgtcctactaagacttaagaatgatacaagtcttcaatttcccatcaccaacaacagtatcaaagctgttattgttgacatgtttgctgccggaacggaaacttcatcaacaacaactgtatgggctatggctgaaatgatgaagaatccaagtgtattcaccaaagctcaagcagaagtgcgagaagcctttagggacaaagtatcttttgatgaaaacgatgtggaggagctgaaatacttaaagttagtcattaaagaaactttgagacttcatccaccctctccacttttggtcccaagagaatgcagggaagacacagatataaacggctacactattcctgcgaagaccaaagttatggttaatgtttgggcattgggaagagatccaaaatattgggatgacgccgaaagctttaagccagagagatttgagcaatgctctatggatttttttggtaataattttgagtttcttccctttggtggtggacggagaatttgtcctggaatgtcatttggtttagctaatctttacttgccattggcccaattgctgtatcacttcgactggaaactcccaactggaatcaagccaagagacttggacttgactgaattatctggaataactattgctagaaagggtgacctttacttaaatgccactccttatcaaccgtcgagactaatttaatattggcatcaactttttaaattttcttcatcaacctcattattaatgtacaataatctttcttctgttgttgtaggctttatcgatttccaatacatgtattctttatttaaaaatgtatcacattccatgtataaaaaaaaaaaaa

SEQ ID NO: 480 - protein, 256 aa, Nicotiana tabacum
INEHKKNLAAGKSNGALGGEDLIDVLLRLKNDTSLQFPITNNSIKAVIVDMFAAGTETSSTTTVWAMAEMMKNPSVFTKAQAEVREAFRDKVSFDENDVEELKYLKLVIKETLRLHPPSPLLVPRECREDTDINGYTIPAKTKVMVNVWALGRDPKYWDDAESFKPERFEQCSMDFFGNNFEFLPFGGGRRICPGMSFGLANLYLPLAQLLYHFDWKLPTGIKPRDLDLTELSGITIARKGDLYLNATPYQPSRLI

SEQ ID NO: 481 - DNA, 1394 bp, Nicotiana tabacum
aaataatggattatcatatttctttccattttcaagctcttttagggcttttagcctttgtgttcttgtctattatcttatggagaagaacactcacttcaagaaaattagcccctgaaatcccaggggcatggcctattataggccatcttcgtcagctgagtggtactgataagaatatcccatttccccgaatattgggcgctttggcagataaatatggacctgtcttcacactgagaatagggatgtacccctatttgattgtcaacaattgggaagcagctaaggattgtctcacaacgcatgataaggactccgctgcccgaccaacttctatggctggtgaaagcatcgggtacaagtatgcgaggtttacttatgctaattttggtccttattataaccaagtgcgcaaactagccctacaacatgtactctcgagtactaaactcgagaaaatgaaacacatacgtgtttctgaattggaaactagcatcaaagaattatattctttgacgctgggcaaaaacaacatgcaaaaagtgaatataagtaaatggtttgaacaattgactttaaacataatcgtgaagacaatttgtggcaagagatatagcaacatagaggaggatgaagaggcacaacgtttcagaaaggcatttaagggcatcatgtttgttgtagggcaaattgttttatatgacgcaattccattcccattgttcaaatactttgatttccaaggtcatatacaattgatgaacaaaatttataaagacttagattctattcttcaaggatggttggatgatcatatgatgaacaaggatgtaaacaataaggatcaagatgccatagatgccatgcttaaggtaacacaacttaatgaattcaaagcctatggtttttctcaggccactgtgatcaagtcgacagtcttgagtttgatcttagatggaaatgacacaaccgctgttcatttgatatgggtaatgtccttattactgaacaatccacatgttatgaaacaaggccaagaagagatagacatgaaagtgggtaaagagaggtggattgaagatactgacataaaaaatttagtgtaccttcaggctatcgttaaagagacattgcgcttgtatccacctgttccttttcttttaccacacgaagcagtgcaagattgtaaagtgactggttaccacattcctaaaggtactcgtctatatatcaatgcgtggaaagtacatcgcgatcctgaaatttggtcagagcccgaaaagtttatgcccaatagattcttgactagcaaagcaaatatagatgctcgcggtcaaaattttgaatttataccgtttggttctgggagacggtcatgtccagggataggt

SEQ ID NO: 482 - protein, 463 aa, Nicotiana tabacum
MDYHISFHFQALLGLLAFVFLSIILWRRTLTSRKLAPEIPGAWPIIGHLRQLSGTDKNIPFPRILGALADKYGPVFTLRIGMYPYLIVNNWEAAKDCLTTHDKDSAARPTSMAGESIGYKYARFTYANFGPYYNQVRKLALQHVLSSTKLEKMKHIRVSELETSIKELYSLTLGKNNMQKVNISKWFEQLTLNIIVKTICGKRYSNIEEDEEAQRFRKAFKGIMFVVGQIVLYDAIPFPLFKYFDFQGHIQLMNKIYKDLDSILQGWLDDHMMNKDVNNKDQDAIDAMLKVTQLNEFKAYGFSQATVIKSTVLSLILDGNDTTAVHLIWVMSLLLNNPHVMKQGQEEIDMKVGKERWIEDTDIKNLVYLQAIVKETLRLYPPVPFLLPHEAVQDCKVTGYHIPKGTRLYINAWKVHRDPEIWSEPEKFMPNRFLTSKANIDARGQNFEFIPFGSGRRSCPGIG

SEQ ID NO: 483 - DNA, 480 bp, Nicotiana tabacum
aataggccaaaatatatggaaggagatattgttgatcttttgctacaattgaagaaagaacaatcaacaccaattgatcttactttggaggatataaaaggaattctcatgaatgtgttggttgcaggatcagacactagtgcagctgctactgtttgggcaatgacagccttgataaaaaatccaaaaaccatgaaaaaagttcaatcagaaatcagaaaatcaatagggaagaaaggaattgtaaatgaagaagatgtccaaaacatgccttatctcaaagcagtgataaaggaaatatttagattgtatccaccagttccacttctagttccaagagaatcaatggaaaaaaccatattagaaggttatgaaattcggccaggaaccatagttcatgttaacgcttgggctattgcgagggatcctgaaatatgggaaaatccagaagaatttatacctgagagattacttgaatag

SEQ ID NO: 484 - protein, 159 aa, Nicotiana tabacum
NRPKYMEGDIVDLLLQLKKEQSTPIDLTLEDIKGILMNVLVAGSDTSAAATVWAMTALIKNPKTMKKVQSEIRKSIGKKGIVNEEDVQNMPYLKAVIKEIFRLYPPVPLLVPRESMEKTILEGYEIRPGTIVHVNAWAIARDPEIWENPEEFIPERLLE

SEQ ID NO: 485 - DNA, 736 bp, Nicotiana tabacum
gcaagttctttcactagttgtaatagtcctatacattcttcaacaattacacaacaaattcatgaaaaagaaaaagaaacttcctccaggtccaaaagggtttccaattattggaaatctatttatgattggcaaaaacctacatcaagatctttatcaaatagccaaaaaacatggtcctataatgagtatgagatttggtctagttcctatcattgttgcttcatctcctcatgctgctgaactattcttgaaaaaacatgatcttgtttttgctagtagaccatataatacagctgctcaatatattggatataatcaaagaaatcttacttttggtaaatatggtccttattggcgaaatatgcgaaaattatgtacgttagaattgcttagtagtctcaagatcaattcatttcaggccatgagaaaacaagaaattggaaattttgtgacttttctcaatagagcagcttctaatggtattgaggttgatattagtgctaaacttgcttcattaagtgcaaatatggcttgtttaatggtatttgggaagaaatatatggatgaagaatttgatgaaaggggttttaaagatgtaattcaagagacattagttataactgcaacaccaaatattggtgagttttttccttttcttgataggtttgatttgcagggatttgttccacgtatgaaaaaattggcaaagatttttgatgattttttcgagaaa

SEQ ID NO: 486 - protein, 245 aa, Nicotiana tabacum
QVLSLVVIVLYILQQLHNKFMKKKKKLPPGPKGFPIIGNLFMIGKNLHQDLYQIAKKHGPIMSMRFGLVPIIVASSPHAAELFLKKHDLVFASRPYNTAAQYIGYNQRNLTFGKYGPYWRNMRKLCTLELLSSLKINSFQAMRKQEIGNFVTFLNRAASNGIEVDISAKLASLSANMACLMVFGKKYMDEEFDERGFKDVIQETLVITATPNIGEFFPFLDRFDLQGFVPRMKKLAKIFDDFFEK

SEQ ID NO: 487 - DNA, 509 bp, Nicotiana tabacum
cgtgaatccattgaagattgtattgttgatggttttgatatacctaaaggttcaagaattttagtaaatacttgggcaattggaagagatccagaagcctggcccgaacccgagaagttcaagccagaaaggtttgttggtagcaacatcgatcttaggggacgtgattttcaacttttaccatttggctcagggagaaggagttgccccggattacaattagggctcaccattgttcgcttggtgttagcgcaattggttcattgctttgattgggaactaccaaatggtatggcgccagaagatttagatatgactgagaaatttggtttagttacagctagagctcaacatttagttgctattcctacttatcaattgcatgtgtagttgatgtgaatcttcctagaagcttaattaagtaaaaatgaagatctttgtcctctatatttttcattgtatgacaaaatttggtaacatttactacatatggagctaccactaaaaaa

SEQ ID NO: 488 - protein, 129 aa, Nicotiana tabacum
RESIEDCIVDGFDIPKGSRILVNTWAIGRDPEAWPEPEKFKPERFVGSNIDLRGRDFQLLPFGSGRRSCPGLQLGLTIVRLVLAQLVHCFDWELPNGMAPEDLDMTEKFGLVTARAQHLVAIPTYQLHV

SEQ ID NO: 489 - DNA, 532 bp, Nicotiana tabacum
tcgacgactataatttgggcattagctgaaatgatgaagaaaccaagtgttttagcaaaggcacaagctgaagtaaggcaagctttgaaggagaaaaaaggttttcaacagattgatcttgatgagctaaaatatctcaagttagtaatcaaagaaaccttaagaatgcaccctccaattcctctattagttcctagagaatgtatggaggatacaaagattgatggttacaatatacctttcaaaacaagagtcatagttaatgcatgggcaatcggacgagatccagaaagttgggatgaccccgaaagctttatgccagagagatttgagaatagttctattgactttcttggaaatcatcatcagtttataccatttggtgcaggaagaaggatttgtccgggaatgctatttggtttagctaatgttggacaacctttagctcagttactttatcacttcgattggaaactccctaatggacaaagtcatgagaatttcgacatgactgagtcacctggaatttctg

SEQ ID NO: 490 - protein, 177 aa, Nicotiana tabacum
STTIIWALAEMMKKPSVLAKAQAEVRQALKEKKGFQQIDLDELKYLKLVIKETLRMHPPIPLLVPRECMEDTKIDGYNIPFKTRVIVNAWAIGRDPESWDDPESFMPERFENSSIDFLGNHHQFIPFGAGRRICPGMLFGLANVGQPLAQLLYHFDWKLPNGQSHENFDMTESPGIS

SEQ ID NO: 491 - DNA, 1518 bp, Nicotiana tabacum
tgctctttctactctttgtagcccttcctttcattcttatttttcttcttcctaaattcaaaaatggtggaaataacagattgccaccaggtcctataggtttaccattcattggaaatttgcatcaatacgatagtataactcctcatatctatttttggaaactttcaaaaaaatatggcaaaatcttctcattaaaacttgcttctactaatgtggtagtagtttcttcagcaaaattagcaaaagaagtattgaaaaaacaagatttaatattttgtagtagaccatctattcttggccaacaaaaactgtcttattatggtcgtgatattgcttttaatgattattggagagaaatgagaaaaatttgtgttcttcatctttttagtttaaaaaaagttcaattatttagtccaattcgtgaagatgaagtttttagaatgattaagaaaatatcaaaacaagcttctacttcacaaattattaatctgagtaatttaatgatttcattaacaagtacaattatttgtagagttgcttttggtgttaggattgaagaagaagcacatgcaaggaagagatttgattttcttttggccgaggcacaagaaatgatggctagtttctttgtatctgatttttttccctttttaagttggattgataaattaagtggattgacatatagacttgagaggaatttcaaggatttggataatttttatgaagaactcattgagcaacatcaaaatcctaataagccaaaatatatggaaggagatattgttgatcttttgctacaattgaagaaagagaaattaacaccacttgatctcactatggaagatataaaaggaattctcatgaatgtgttagttgcaggatcagacactagtgcagctgctactgtttgggcaatgacagccttgataaagaatcctaaagccatggaaaaagttcaattagaaatcagaaaatcagttgggaagaaaggcattgtaaatgaagaagatgtccaaaacatcccttattttaaagcagtgataaaggaaatatttagattgtatccaccagctccacttttagttccaagagaatcaatggaaaaaaccatattagaaggttatgaaattcggccaagaaccatagttcatgttaacgcttgggctatagcaagggatcctgaaatatgggaaaatccagatgaatttatacctgagagatttttgaatagcagtatcgattacaagggtcaagattttgggttacttccatttggtgcaggcagaagaggttgcccaggtattgcacttggggttgcatccatggaacttgctttgtcaaatcttctttatgcatttgattgggagttgccttatggagtgaaaaaagaagacatcgacacaaacgttaggcctggaattgccatgcacaagaaaaacgaactttgccttgtcccaaaaaattatttataaattatattgggacgtggatctcatgctagttctgtgaagg

SEQ ID NO: 492 - protein, 491 aa, Nicotiana tabacum
LFLLFVALPFILIFLLPKFKNGGNNRLPPGPIGLPFIGNLHQYDSITPHIYFWKLSKKYGKIFSLKLASTNVVVVSSAKLAKEVLKKQDLIFCSRPSILGQQKLSYYGRDIAFNDYWREMRKICVLHLFSLKKVQLFSPIREDEVFRMIKKISKQASTSQIINLSNLMISLTSTIICRVAFGVRIEEEAHARKRFDFLLAEAQEMMASFFVSDFFPFLSWIDKLSGLTYRLERNFKDLDNFYEELIEQHQNPNKPKYMEGDIVDLLLQLKKEKLTPLDLTMEDIKGILMNVLVAGSDTSAAATVWAMTALIKNPKAMEKVQLEIRKSVGKKGIVNEEDVQNIPYFKAVIKEIFRLYPPAPLLVPRESMEKTILEGYEIRPRTIVHVNAWAIARDPEIWENPDEFIPERFLNSSIDYKGQDFGLLPFGAGRRGCPGIALGVASMELALSNLLYAFDWELPYGVKKEDIDTNVRPGIAMHKKNELCLVPKNYL

SEQ ID NO: 493 - DNA, 987 bp, Nicotiana tabacum
ctcattatccatcacctaaaatggagaattcttgggtttttctagccttggcagggctatctgcattagcttttctctgtaaaataatcacctgtcgaagaccggttaaccggaaaataccaccaggtccaaaaccatggcccatcattggcaatttgaacctacttggtcctataccacatcaatcttttgacttgctttccaaaaaatatggagagttgatgctgctgaaatttggctccaggccagttcttgttgcttcatctgctgaaatggcaaaacagtttttaaaagtacatgatgctaatttcgcctcccgtcctatgctagctggtggaaagtatacaagctataactattgtgacatgacatgggcaccctatggtccctattggcgccaagcacgacgaatttaccttaaccagatatttactccgaaaaggctagactcgttcgagtacattcgtgttgaagaaaggcaggccttgatttcccagctgaattcccttgctggaaagccattttttctcaaagaccatttgtcgcgatttagcctctgcagcatgacaaggatggttttgagcaacaagtattttggtgaatcaacagttagagtagaagatttgcagtacctggtagatcaatggttcttacttaatggtgctttcaacattggagattggattccatggctcagcttcttggacctacaaggctatgtgaaacaaatgaaggctttgaaaagaacttttgataagttccacaacattgtgctagatgatcacagggctaagaagaatgcagagaagaactttgtcccaaaagacatggttgatgtcttgttgaagatggctgaagatcctaatctggaagtcaaactcactaatgactgtgtcaaagggttaatgcaggatttactaactggaggaacagatagcttaacagcagcagtgcaatgggcatttcaagaacttcttagacagccaa

SEQ ID NO: 494 - protein, 322 aa, Nicotiana tabacum
MENSWVFLALAGLSALAFLCKIITCRRPVNRKIPPGPKPWPIIGNLNLLGPIPHQSFDLLSKKYGELMLLKFGSRPVLVASSAEMAKQFLKVHDANFASRPMLAGGKYTSYNYCDMTWAPYGPYWRQARRIYLNQIFTPKRLDSFEYIRVEERQALISQLNSLAGKPFFLKDHLSRFSLCSMTRMVLSNKYFGESTVRVEDLQYLVDQWFLLNGAFNIGDWIPWLSFLDLQGYVKQMKALKRTFDKFHNIVLDDHRAKKNAEKNFVPKDMVDVLLKMAEDPNLEVKLTNDCVKGLMQDLLTGGTDSLTAAVQWAFQELLRQP

SEQ ID NO: 495 - DNA, 980 bp, Nicotiana tabacum
atgatcgctgggaaaaattatggatccggtaaaggagatgaacaagtggagagatttgggaaagcgtttaaggattttataattttatcaatggagtttgtgttatgggatgcttttccaattccattgttcaaatgggtggatcttcaaggccatgttaaggccatgaaaaggacatttaaggatatagattctgtttttcagaattggttagaggaacatgtcaagaaaaaagaaaaaatggaggttaatgcagaaggaaatgaacaagatttcattgatgtggtgctttcaaaaatgagtaatgaatatcttgatgaaggctactctcgtgatactgtcataaaagcaacagtgtttagtttagtcttggatgctgcggacacagttgctcttcacatgaattggggaatggcattattgacaaacaatcaacatgccttgaagaaagcgcaagaagagatagataaaaaagttggtaaggatagatgggtagaagagagtgatattaaggatttggtatacctccaaactattgttaaagaagtgttacgattatatccaccgggacctttattagtaccccatgaaaatgtagaggattgtgttgttagtggatatcacattcctaaagggactagactattcgcgaacgttatgaaattacagcgcgatcctaaactctggtcaaatcctgataagttcgatccagagagatttttcgctgctgatattgactttcgtggtcaacactatgagtttatcccatttggttctggaagacgatcttgtccggggatgacttatgcaatgcaagtggaacacctaacaatcgcacacttgatccagggtttcaattacaaaactccaaatgacgagcccttggatatgaaggaaggtgcaggattaactatacgtaaggtaaatcctatagaagtggtaattacgcctcgcctgacacctgagctttattaaaatct

SEQ ID NO: 496 - protein, 324 aa, Nicotiana tabacum
MIAGKNYGSGKGDEQVERFGKAFKDFIILSMEFVLWDAFPIPLFKWVDLQGHVKAMKRTFKDIDSVFQNWLEEHVKKKEKMEVNAEGNEQDFIDVVLSKMSNEYLDEGYSRDTVIKATVFSLVLDAADTVALHMNWGMALLTNNQHALKKAQEEIDKKVGKDRWVEESDIKDLVYLQTIVKEVLRLYPPGPLLVPHENVEDCVVSGYHIPKGTRLFANVMKLQRDPKLWSNPDKFDPERFFAADIDFRGQHYEFIPFGSGRRSCPGMTYAMQVEHLTIAHLIQGFNYKTPNDEPLDMKEGAGLTIRKVNPIEVVITPRLTPELY

SEQ ID NO: 497 - DNA, 513 bp, Nicotiana tabacum
gcagtgatcttagaaggtcttaggcgacacccgcccggtcactttgtgctgccacatacggtgacagaggaagcagaactgaacggctacgtcgtcccaaagaatgccaccatcaatttcatggttgccgacatgggtttggacccaaaggtgtgggaggatcccttggaatttaagccagagaggttcttaatggagggatcagataaggaagggtttgatataacaggaagtagagagatcaagatgatgccatttggagctggtaggagaatatgtcctggctatgctttggctatgcttcatttggaatactttgtggctaatttggtttggcattttcgatgggatgctgtggagggagatgatgttgatctttcagagaagctagaattcaccgttgtgatgaagaatcctctacgagctcgtatctgccctagagttaactctgtttgaatttggtaattactagtagttctttctatttgcattgttccctgttgatggacttcc

SEQ ID NO: 498 - protein, 151 aa, Nicotiana tabacum
AVILEGLRRHPPGHFVLPHTVTEEAELNGYVVPKNATINFMVADMGLDPKVWEDPLEFKPERFLMEGSDKEGFDITGSREIKMMPFGAGRRICPGYALAMLHLEYFVANLVWHFRWDAVEGDDVDLSEKLEFTVVMKNPLRARICPRVNSV

SEQ ID NO: 499 - DNA, 419 bp, Nicotiana tabacum
ttcgcatggataggcccagaacccaggattttcgtaatgaaaccagaattgataaaggaaatagtaacgaacaacaccatcttcaaaaaaccaaaaccagccccacttgtccagcttcttgttagtggcatctcaagttatgaggacgacaaatgggctaagcacagaaaaattcttaacactgcattttacgccgagaagttgaagtgtatgctgccggcaatgcacacaagctgtgaagatatgatcaacaagtgggaaattctactctccgaaaacaaatcctgcgaattggacgtgcatccatattttgaagattttaccagtgatgtgatttcaagaacagcatttggaagtagttatgcagaaggaacaagaatatttcatcttcaaaaagaactagctgaactcacacgcca

SEQ ID NO: 500 - protein, 139 aa, Nicotiana tabacum
FAWIGPEPRIFVMKPELIKEIVTNNTIFKKPKPAPLVQLLVSGISSYEDDKWAKHRKILNTAFYAEKLKCMLPAMHTSCEDMINKWEILLSENKSCELDVHPYFEDFTSDVISRTAFGSSYAEGTRIFHLQKELAELTR

SEQ ID NO: 501 - DNA, 557 bp, Nicotiana tabacum
atgagtttagtaaaatcagtagtgtatgaagtattaagaattgaacctccagttccattccaatatggtaaagccaaagaagatatcataatccaaagccatgattcaactttcttagtcaagaaaggtgaaatgatctttggatatcagccttttgctacaaaagatccaaagatttttgacaaaccagaggagtttattccggagaggttcatggccgaaggggaaaaattattaaagtatgtgtattggtcaaatgcaagagagacagatgatccaacggtggacgacaaacaatgcccagcgaaaaatcttgtcgtgcttttgtgcaggttgatgttggtggaggttttcatgcgttacgacacattcacagtggagtcaacaaagctctttcttgggtcatcagtaacgttcacgactctggaaaaagcgacatgagtttcagatatcttaattgtaggctgcaaataataatgtggtcattctgcaaattattgtacttgtgctgatgtacttgacttcgagtggatataataatgcactgtttttagaaa

SEQ ID NO: 502 - protein, 146 aa, Nicotiana tabacum
MSLVKSVVYEVLRIEPPVPFQYGKAKEDIIIQSHDSTFLVKKGEMIFGYQPFATKDPKIFDKPEEFIPERFMAEGEKLLKYVYWSNARETDDPTVDDKQCPAKNLVVLLCRLMLVEVFMRYDTFTVESTKLFLGSSVTFTTLEKAT

SEQ ID NO: 503 - DNA, 389 bp, Nicotiana tabacum
gttggaacaagtagttggcacaaacagaatggtggaagaatcagatttggaaaaattagattacttagatatggttgtaaaagaaggttttaggcttcaccctgttgcaccactattacttcctcgtgaatccattgaagattgtattgttgatggttttgatatacctaaaggttcaagaattttagtaaatacttgggcaattggaagagatccagaagcctggcccgaacccgagaagttcaagccagaaaggtttgttggtagcaacatcgatcttaggggacgtgattttcaacttttaccatttggctcagggagaaggagttgccccggattacaattagggctcaccattgttcgcttggtgttagcgcaattggttcatt

SEQ ID NO: 504 - protein, 129 aa, Nicotiana tabacum
LEQVVGTNRMVEESDLEKLDYLDMVVKEGFRLHPVAPLLLPRESIEDCIVDGFDIPKGSRILVNTWAIGRDPEAWPEPEKFKPERFVGSNIDLRGRDFQLLPFGSGRRSCPGLQLGLTIVRLVLAQLVH

SEQ ID NO: 505 - DNA, 405 bp, Nicotiana tabacum
ctatatggagacacaaaggagatggctgagatgaccaaagaagccaagtttaaacccattaaactcactgatgatattctccctcggatcttccctttctaccatcatactttcaacaaatatggtaaccattgtttcgcatggataggcccagaacccaggattttcgtaatgaaaccagaattgataaaggaaatagtaacgaacaacaccatcttcaaaaaaccaaaaccagccccacttgtccagcttcttgttagtggcatctcaagttatgaggacgacaaatgggctaagcacggaaaaattcttaacactgcattttacgccgagaagttgaagtgtatgctgccggcaatgcacacaagctgtgaagatatgatcaacaagtgggaaattctactc

SEQ ID NO: 506 - protein, 135 aa, Nicotiana tabacum
LYGDTKEMAEMTKEAKFKPIKLTDDILPRIFPFYHHTFNKYGNHCFAWIGPEPRIFVMKPELIKEIVTNNTIFKKPKPAPLVQLLVSGISSYEDDKWAKHGKILNTAFYAEKLKCMLPAMHTSCEDMINKWEILL

SEQ ID NO: 507 - DNA, 445 bp, Nicotiana tabacum
tacgtacgttacatttacccatgcagtaacggagccaacaacattgggtgggtatgacatacccacatatgctaatgtagagttttttgtacccgggatctcggatgacccgaaagtttggtctgatccggaaaagtttgacccggataggtttctatccgggcgggaggacgctgatataacgggtgtgaccggggtaaagatgatgccatttggggtcgggcggaggatttgtccgggcttgggcttggcaacggtgcatgtgaatttgatgttggcccgaatgattcaagaatttgaatggtccgcttacccggaaaataggaaagtggattttactgagaaattggaatttactgtggtgatgaaaaatcctttaagagctaaggtcaagccaagaatgcaagtggtgtaattcattaagattataagtccaaaaataagc

SEQ ID NO: 508 - protein, 137 aa, Nicotiana tabacum
TYVTFTHAVTEPTTLGGYDIPTYANVEFFVPGISDDPKVWSDPEKFDPDRFLSGREDADITGVTGVKMMPFGVGRRICPGLGLATVHVNLMLARMIQEFEWSAYPENRKVDFTEKLEFTVVMKNPLRAKVKPRMQVV

SEQ ID NO: 509 - DNA, 574 bp, Nicotiana tabacum
agaagagatagacatgaaagtgggtaaagagaggtggattgaagatactgacataaaaaatttagtgtaccttcaggctatcgttaaagagacattgcgcttgtatccacctgttccttttcttttaccacacgaagcagtgcaagattgtaaagtgactggttaccacattcctaaaggtactcgtctatatatcaatgcgtggaaagtacatcgcgatcctgaaatttggtcagagcccgaaaagtttatgcccaatagattcttgactagcaaagcaaatatagatgctcgcggtcaaaattttgaatttataccgtttggttctgggagacggtcatgtccagggataggttttgcgactttagtgacacatctgacttttggtcgcttgcttcaaggttttgattttagtaagccatcaaacacgccaattgacatgacagaaggcgtaggcgttactttgcctaaggttaatcaagttgaagttctaattatccctcgtttaccttctaagctttatttattttgaaagtgcaaatcatcaatcatgggttgagtaattagtgatact

SEQ ID NO: 510 - protein, 176 aa, Nicotiana tabacum
EEIDMKVGKERWIEDTDIKNLVYLQAIVKETLRLYPPVPFLLPHEAVQDCKVTGYHIPKGTRLYINAWKVHRDPEIWSEPEKFMPNRFLTSKANIDARGQNFEFIPFGSGRRSCPGIGFATLVTHLTFGRLLQGFDFSKPSNTPIDMTEGVGVTLPKVNQVEVLIIPRLPSKLYLF

SEQ ID NO: 511 - DNA, 1137 bp, Nicotiana tabacum
aacatttggcaatatagtcttcctcctcagttcttgcctcctgttccttagaaataatggattatcatatttctttccatcttccaactctttttgggctttttgcctttgtgttcttgtctattatcttatggagaagaacactcaattcaagaagattagcccctgaaatcccaggggcatggcctattataggccatcttcgtcagctgagtggtactgataagaatatcccatttccccgaatattgggcgctttggcagataaatatggacctgtcttcacactgagaatagggatgtacccctatttgattgtcaacaattgggaagcagctaaggattgtctcacaacgcatgataaggacttcgctgcccgaccaacttctatggctggtgaaagcatcgggtacaagtatgcgaggtttacttatgctaattttggtccttattataaccaagtgcgcaaactagccctacaacatgtactctcgagtactaaactcgagaaaatgaaacacatacgtgtttctgaattggaaactagcatcaaagaattatattctttgacgctgggcaaaaacaacatgcaaaaagtgaatataagtaaatggtttgaacaattgactttaaacataatcgtgaagacaatttgtggcaagagatatagcaacatagaggaggatgaagaggcacaacgtttcagaaaggcatttaagggcatcatgtttgttgtagggcaaattgttttatatgacgcaattccattcccattgttcaaatactttgatttccaaggtcatatacaattgatgaacaaaatttataaagacttagattctattcttcaaggatggttggatgatcatatgatgaacaaggatgtaaacaataaggatcaagatgccatagatgccatgcttaaggtaacacaacttaatgaattcaaagcctatggtttttctcaggccactgtgatcaagtcgacagtcttgagtttgatcttagatggaaatgacacaaccgctgttcatttgatatgggtaatgtccttattactgaacaatccacatgttatgaaacaaggccaagaagagatagacatgaaagtgggtaaagagaggtggattgaagata

SEQ ID NO: 512 - protein, 360 aa, Nicotiana tabacum
MDYHISFHLPTLFGLFAFVFLSIILWRRTLNSRRLAPEIPGAWPIIGHLRQLSGTDKNIPFPRILGALADKYGPVFTLRIGMYPYLIVNNWEAAKDCLTTHDKDFAARPTSMAGESIGYKYARFTYANFGPYYNQVRKLALQHVLSSTKLEKMKHIRVSELETSIKELYSLTLGKNNMQKVNISKWFEQLTLNIIVKTICGKRYSNIEEDEEAQRFRKAFKGIMFVVGQIVLYDAIPFPLFKYFDFQGHIQLMNKIYKDLDSILQGWLDDHMMNKDVNNKDQDAIDAMLKVTQLNEFKAYGFSQATVIKSTVLSLILDGNDTTAVHLIWVMSLLLNNPHVMKQGQEEIDMKVGKERWIED

SEQ ID NO: 513 - DNA, 254 bp, Nicotiana tabacum
gtaaatgaagaagatgtccaaaacatcccttattttaaagcagtgataaaggaaatatttagattgtatccaccagctccacttttagttccaagagaatcaatggaaaaaaccatattagaaggttatgaaattcggccaagagccatagttcatgttaacgcttgggctatagcaagggatcctgaaatatgggaaaatccagatgaatttatacctgagagatttttgaatagcagtatcgattacagggt

SEQ ID NO: 514 - protein, 84 aa, Nicotiana tabacum
VNEEDVQNIPYFKAVIKEIFRLYPPAPLLVPRESMEKTILEGYEIRPRAIVHVNAWAIARDPEIWENPDEFIPERFLNSSIDYR

SEQ ID NO: 515 - DNA, 519 bp, Nicotiana tabacum
aagagtaatggtgcattaggaggtgaagatctaattgatgtcctactaagacttaagaatgatacaagtcttcaatttcccatcaccaacaacaatatcaaagctgttattgttgacatgtttgctgccggaacggaaacttcatcaacaacaactgtatgggctatggctgaaatgatgaagaatccaagtgtattcaccaaagctcaagcagaagtgcgagaagcctttagggacaaagtatcttttgatgaaaacgatgtggaggagctgaaatacttaaagttagtcattaaagaaactttgagacttcatccaccctctccacttttggtcccaagagaatgcagggaagacacagatataaacggctacactattcctgcgaagaccaaagttatggttaatgtttgggcattgggaagagatccaaaatattgggatgacgccgaaagctttaagccagagagatttgagcaatgctctatggatttttttggtaataattttgagtttctt

SEQ ID NO: 516 - protein, 174 aa, Nicotiana tabacum
KSNGALGGEDLIDVLLRLKNDTSLQFPITNNNIKAVIVDMFAAGTETSSTTTVWAMAEMMKNPSVFTKAQAEVREAFRDKVSFDENDVEELKYLKLVIKETLRLHPPSPLLVPRECREDTDINGYTIPAKTKVMVNVWALGRDPKYWDDAESFKPERFEQCSMDFFGNNFEFLP

SEQ ID NO: 517 - DNA, 340 bp, Nicotiana tabacum
ttaaaccaccctgaaactctgaagaaagcacaagctgaaattgatgaacatataggacatgaacgtttagtggacgagtcggacatcaacaacctaccttacctacgttgtataatcaacgagacattccgaatgtaccctgcaggaccactactagtcccacacgagtcgtcagaggaaaccaccgtaggaggctaccgtgtacccggaggaaccatgttacttgtgaatttgtgggctattcacaatgatccaaagctatgggatgaaccaagaaagtttaagccagaaagatttgaaggactagaaggtgttagagatggttacaaaatgatgccct

SEQ ID NO: 518 - protein, 113 aa, Nicotiana tabacum
LNHPETLKKAQAEIDEHIGHERLVDESDINNLPYLRCIINETFRMYPAGPLLVPHESSEETTVGGYRVPGGTMLLVNLWAIHNDPKLWDEPRKFKPERFEGLEGVRDGYKMMP

SEQ ID NO: 519 - DNA, 218 bp, Nicotiana tabacum
gtcaggtttcatcctatagctccagtattagcacctagagaatcaagggaagagtgtgagattaatggctatgttataccaaaaggcacaatggcccttgtgaatttttgggcaatttctagggatccaaattattggtcaaatcctgaaacatttgatccagagagatttaatgaaagtcaccttgattttactggagctcatttcgagtttacgcc

SEQ ID NO: 520 - protein, 72 aa, Nicotiana tabacum
VRFHPIAPVLAPRESREECEINGYVIPKGTMALVNFWAISRDPNYWSNPETFDPERFNESHLDFTGAHFEFT

SEQ ID NO: 521 - DNA, 369 bp, Nicotiana tabacum
gttatttgggcattagcagaaatgataaagaatccaagtgtaatggcgaaagcacaagcagaagtgagagaagcttttaaaggaaagaaaacatgtgatgaggatactgatcttgaaaagcttagttacctaaatttagtgatcaaagagacactccgattacaccctccaactcctctacttgtcccgcgagaatgcagggaggaaacagagattgaaggattcactataccgttgaaaagcaaagtcttggttaacgtatgggcaattggaagagatcccgagaattggggaaatcctgaatgttttataccagagagattcgaaaatagttctattgagtttactggaaatcattttcaacttctt

SEQ ID NO: 522 - protein, 123 aa, Nicotiana tabacum
VIWALAEMIKNPSVMAKAQAEVREAFKGKKTCDEDTDLEKLSYLNLVIKETLRLHPPTPLLVPRECREETEIEGFTIPLKSKVLVNVWAIGRDPENWGNPECFIPERFENSSIEFTGNHFQLL

SEQ ID NO: 523 - DNA, 462 bp, Nicotiana tabacum
gaatatcttggtgaaggttactctcgtgatactgtcattaaagcaacggtgtttagtttggtcttggatgcagcagacacagttgctcttcacataaattggggaatggcattattgataaacaatcaaaaggccttgacgaaagcacaagaagagatagacacaaaagttggtaaggacagatgggtagaagagagtgatattaaggatttggtatacctccaagctattgttaaagaagtgttacgattatatccaccaggacctttgttagtaccacacgaaaatgtagaagattgtgttgttagtggatatcacattcctaaagggacaagattattcgcaaacgtcatgaaactgcaacgtgatcctaaactctggtctgatcctgatactttcgatccagagagattcattgctactgatattgactttcgtggtcagtactataagtatatcccc

SEQ ID NO: 524 - protein, 93 aa, Nicotiana tabacum
RWVEESDIKDLVYLQAIVKEVLRLYPPGPLLVPHENVEDCVVSGYHIPKGTRLFANVMKLQRDPKLWSDPDTFDPERFIATDIDFRGQYYKYI

SEQ ID NO: 525 - DNA, 417 bp, Nicotiana tabacum
cttatggtggatttattcattgctggaagtgacacatctgctataacaacagaatgggcaatggcagaacttcttcgaaaacctcaagtacttaacaaagtaagagaagaaatacttcaacaaataggcacagaaagaccagtgaaagaatcagacattgagaaacttccataccttcaagcagttgtaaaagaagcaatgagacttcatccggcagtttcattactcttgccacacaaagcccaaaatgatatacaagtgttgggctacactgtgcctaagaacactcaagttctcgtgaatgcttgggcaattggaagagatccaaaatcctgggataagccactggagtttatgcctgaaagattcataaagtctagtgtggattacaaaggtagggactttgagtttataccc

SEQ ID NO: 526 - protein, 139 aa, Nicotiana tabacum
LMVDLFIAGSDTSAITTEWAMAELLRKPQVLNKVREEILQQIGTERPVKESDIEKLPYLQAVVKEAMRLHPAVSLLLPHKAQNDIQVLGYTVPKNTQVLVNAWAIGRDPKSWDKPLEFMPERFIKSSVDYKGRDFEFIP

SEQ ID NO: 527 - DNA, 501 bp, Nicotiana tabacum
cacatgaaaatgtaaaggattgtgttgttagtggatatcacattcctaaagggactagattattcgcaaacgtcatgaaactgcagcgcgatcctaaactcttgtcaaatcctgataagttcgatccagagagattcatcgctggtgatattgacttccgtggtcaccactatgagtttatcccatttggttctggaagacgatcttgtccggggatgacttatgcattgcaagtggaacacctaacaatggcacatttaatccagggtttcaattacaaaactccaaatgacgaggccttggatatgaaggaaggtgcaggcataacaatacgtaaggtaaatccagtggaattgataataacgcctcgcttggtacctgagctttactaaaacctaagatctttcatcttggttgatcattggttaatactcctagatgggtattcatttaccttttttcaattaattgcatgtccagcttttttaatttggtatattt

SEQ ID NO: 528 - protein, 129 aa, Nicotiana tabacum
HENVKDCVVSGYHIPKGTRLFANVMKLQRDPKLLSNPDKFDPERFIAGDIDFRGHHYEFIPFGSGRRSCPGMTYALQVEHLTMAHLIQGFNYKTPNDEALDMKEGAGITIRKVNPVELIITPRLVPELY

SEQ ID NO: 529 - DNA, 304 bp, Nicotiana tabacum
tataagtatatcccgtttggttctggaagacgatcttgtccagggatgacttatgcattgcaagtggaacacttaacaatggcacatttgatccaaggtttcaattacagaactccaaatgacgagcccttgggtatgaaggaaggtgcaggcataactatacgtaaggtaaatcctgtggaactgataatagcgcctcgcctggcacctgagctttattaaaacctaagatctttcatcttggttgatcattgtataatactcctaaatggatattcatttaccttttatcaattaattgtca

SEQ ID NO: 530 - protein, 73 aa, Nicotiana tabacum
YKYIPFGSGRRSCPGMTYALQVEHLTMAHLIQGFNYRTPNDEPLGMKEGAGITIRKVNPVELIIAPRLAPELY

SEQ ID NO: 531 - DNA, 403 bp, Nicotiana tabacum
ttttaaagatatagattctgtttttcagaattggttagaggaacgtattaataaaagagaaaaaatggaggttaatgcagaagggaatgaacaagatttcattgatgtggtgctttcaaaaatgagtaatgaatatcttggtgaaggttactctcgtgatactgttattaaagcaacggtgtttagtttggtcttggatgcagcagacacagttgctcttcacataaattggggaatggcattattgataaacaatcaaaatgccttgatgaaagcacaagaagagatagacacaaaagttggtaaggatagatgggtagaagagagtgatattaaggatttagtatacctccaagctattgttaaaaaggtgttacgattatatccaccaggacctttgtta

SEQ ID NO: 532 - protein, 134 aa, Nicotiana tabacum
FKDIDSVFQNWLEERINKREKMEVNAEGNEQDFIDVVLSKMSNEYLGEGYSRDTVIKATVFSLVLDAADTVALHINWGMALLINNQNALMKAQEEIDTKVGKDRWVEESDIKDLVYLQAIVKKVLRLYPPGPLL

SEQ ID NO: 533 - DNA, 304 bp, Nicotiana tabacum
tataagtatatcccgtttggttctggaagacgatcttgtccagggatgacttatgcattgcaagtggaacacttaacaatggcacatttgatccaaggtttcgattacagaactccaaatgacgagcccttggatatgaaggaaggtgcaggcataactatacgtaaggtaaatcctgtggaactgataatagcgcctcgcctggcacctgagctttattaaaacctaagatctttcatcttggttgatcattgtataatactcctaaatggatattcatttaccttttatcaattaattgtca

SEQ ID NO: 534 - protein, 73 aa, Nicotiana tabacum
YKYIPFGSGRRSCPGMTYALQVEHLTMAHLIQGFDYRTPNDEPLDMKEGAGITIRKVNPVELIIAPRLAPELY

SEQ ID NO: 535 - DNA, 344 bp, Nicotiana tabacum
gagattcattgctactgatattgactttcgtggtcagtactataagtatatcccgtttggttctggaaggcgatcttgtccagggatgacttatgcattgcaagtggaacacttaacaatggcacatttgatccaaggtttcaattacagaactccaaatgacgagcccttggatatgaaggaaggtgcaggcataactatacgtaatgtaaatcctgtggaactgataatagcgcctcgcctggcacctgagctttattaaaacctaagatctttcatcttggttgatcattgtataatactcctaaatggatattcatttaccttttatcaattaattgtca

SEQ ID NO: 536 - protein, 86 aa, Nicotiana tabacum
RFIATDIDFRGQYYKYIPFGSGRRSCPGMTYALQVEHLTMAHLIQGFNYRTPNDEPLDMKEGAGITIRNVNPVELIIAPRLAPELY

SEQ ID NO: 537 - DNA, 25 bp, Artificial Sequence
  Probe Sequence
ctggcacctgagctttattaaaacc

SEQ ID NO: 538 - DNA, 18 bp, Artificial Sequence
  Primer
  misc_feature (4)..(6): n = deoxyinosine
  misc_feature (9)..(9): n = deoxyinosine
  misc_feature (15)..(15): n = deoxyinosine
ttynnnccngarmgntty

SEQ ID NO: 539 - DNA, 20 bp, Artificial Sequence
  Primer
  misc_feature (3)..(3): n = deoxyinosine
  misc_feature (6)..(6): n = deoxyinosine
  misc_feature (9)..(9): n = deoxyinosine
  misc_feature (10)..(12): n = deoxyinosine
  misc_feature (18)..(18): n = deoxyinosine
ggnmgnmgnnnntgyccngs

SEQ ID NO: 540 - DNA, 20 bp, Artificial Sequence
  Primer
  misc_feature (3)..(3): n = deoxyinosine
  misc_feature (6)..(6): n = deoxyinosine
  misc_feature (9)..(12): n = deoxyinosine
  misc_feature (18)..(18): n = deoxyinosine
ckncknccnnnnccraangg

SEQ ID NO: 541 - DNA, 17 bp, Artificial Sequence
  Primer
ttyaarcctgagagatt

SEQ ID NO: 542 - DNA, 15 bp, Artificial Sequence
  Primer
ccagaragattcttg

SEQ ID NO: 543 - DNA, 17 bp, Artificial Sequence
  Primer
ggrmgrmgratgtgycc

SEQ ID NO: 544 - DNA, 19 bp, Artificial Sequence
  Primer
  misc_feature (19)..(19): n = a, t, c, or g
ttttttttttttttttttn

SEQ ID NO: 545 - DNA, 20 bp, Artificial Sequence
  Primer
attatgctgagtgatatccc

SEQ ID NO: 546 - DNA, 18 bp, Artificial Sequence
  Primer
atttaggtgacactatag

SEQ ID NO: 547 - protein, 7 aa, Artificial Sequence
  conserved p450 motif
  MISC_FEATURE (2)..(2): Xaa = any amino acid
  MISC_FEATURE (4)..(4): Xaa = any amino acid
  MISC_FEATURE (6)..(6): Xaa = any amino acid
  MISC_FEATURE (7)..(7): Xaa = gly or ala
GXRXCXX

SEQ ID NO: 548 - protein, 7 aa, Artificial Sequence
  conserved p450 motif
  MISC_FEATURE (1)..(1): Xaa =  Glu or Lys
  MISC_FEATURE (2)..(2): Xaa =  any amino acid
  MISC_FEATURE (3)..(3): Xaa =  any amino acid
  MISC_FEATURE (5)..(5): Xaa =  any amino acid
  MISC_FEATURE (6)..(6): Xaa =  any amino acid
  MISC_FEATURE (7)..(7): Xaa = Arg, Thr, Ser or Met
XXXRXXX

SEQ ID NO: 549 - protein, 4 aa, Artificial Sequence
  conserved p450 motif
  MISC_FEATURE (2)..(2): X = any amino acid
  MISC_FEATURE (4)..(4): X = any amino acid
GXRX

SEQ ID NO: 550 - protein, 21 aa, Artificial Sequence
  artificially synthesized peptide
DIDGSKSKLVKAHRKIDEILG

SEQ ID NO: 551 - protein, 20 aa, Artificial Sequence
  Artificially Synthesized Peptide
RDAFREKETFDENDVEELNY

SEQ ID NO: 552 - protein, 22 aa, Artificial Sequence
  Artificially synthesized peptide
FKNNGDEDRHFSQKLGDLADKY

SEQ ID NO: 553 - protein, 6 aa, Artificial Sequence
  conserved p450 motif
  MISC_FEATURE (2)..(2): Xaa = any amino acid
FXPERF

SEQ ID NO: 554 - protein, 7 aa, Artificial Sequence
  conserved p450 motif
  MISC_FEATURE (4)..(4): Xaa = any amino acid
  MISC_FEATURE (7)..(7): Xaa = ala or gly
GRRXCPX

SEQ ID NO: 555 - protein, 7 aa, Artificial Sequence
  conserved p450 motif
  MISC_FEATURE (2)..(2): Xaa = any amino acid
  MISC_FEATURE (4)..(4): Xaa = any amino acid
  MISC_FEATURE (7)..(7): Xaa = ala or gly
GXRXCPX

SEQ ID NO: 556 - protein, 6 aa, Artificial Sequence
  conserved p450 motif
  MISC_FEATURE (2)..(2): Xaa =  any amino acid
  MISC_FEATURE (5)..(5): Xaa =  any amino acid
PXRFXF

SEQ ID NO: 557 - protein, 5 aa, Artificial Sequence
  conserved p450 motif
  MISC_FEATURE (2)..(2): Xaa =  any amino acid
  MISC_FEATURE (4)..(4): Xaa =  any amino acid
GXRXC

SEQ ID NO: 558 - DNA, 39 bp, Artificial Sequence
  primer
ggccagtgaattgtaatacgactcactatagggaggcgg

SEQ ID NO: 559 - DNA, 23 bp, Artificial Sequence
  primer
agcaagatgatcttaggttttaa

SEQ ID NO: 560 - DNA, 36 bp, Artificial Sequence
  primer
caagcaagatgatcttaggttttaataaagctcagg

SEQ ID NO: 561 - DNA, 21 bp, Artificial Sequence
  primer
caattaaccctcactaaaggg

SEQ ID NO: 562 - protein, 509 aa, Nicotiana tabacum
MEGTNLTTYAAVFLGTLFLLFLSKLLRQRKLNLPPGPKPWPIIGNLNLIGNLPYRSIHELSLKYGPVMQLQFGSFPVVVGSSVEMAKIFLKSMDINFVGRPKTAAGKYTTYNYSDITWSPYGPYWRQARRMCLTELFSTKCLDSYEYIRAEELHSLLHNLNKISGKPIVLKDYLTTLSLNVISRMVLGKRYLDESENSFVNPEEFKKMLDELFLLNGVLNIGDSIPWIDFMDLQGYVKRMKVVSKKFDKFLEHVIDEHNIRRNGVENYVAKDMEDVLLQLADDPKLEVKLERHGVKAFTQDMLAGGTESSAVTVEWAISELSKKPEIFKKATEELDRVIGQNRWVQEKDIPNLPYIEAIVKETMRLHPVAPMKATECRENSKVAGYDVQKGTRVLVSVWTIGRDPTLWDEPEVFKPERFHEKASIDVKGHDYELLPFGVGRRMCPGYSLGLKVIQASLANLLHGFNWSLPDNMTPEDLNMDEIFGLSTPKKFPLATVIEPRLSPKLYSV

SEQ ID NO: 563 - protein, 509 aa, Nicotiana tabacum
MEGTNLTTYAAVFLGTLFLLLLSKFLRQRKLNLPPGPKPWPIIGNLNLIGNLPHRSIHELSLKYGPIMQLQFGTFPVVVGSSVEMAKVFLKSMDINFVGRPKTAAGKYTTYNYSDITWSPYGPYWRQARRMCLMELFSTKRLDSYEYIRAEELHSLLHNLNKISGKPIVLKDYLTTLSLNVISRMVLGKRYLDESENSIVTPEEFKKMLDELFLLNGVLNIGDSIPWIDFMDLQGYVKRMKFVSKKFDKFLEHVIDEHNVRRNGVENYIAKDMVDVLLQLADDPTLEVKLERHGVKAFTQDMLAGGTESSAVTVEWAISELLKKPEIFKKATEELDRVIGQNRWVQEKDIPNLPYIEAIVKETMRLHPVAPMLVPRECREDCKVAGYDVKKGTRVLVSVWTIGRDPTLWDEPEAFKPERFHEKSIDVKGHDFELLPFGAGRRMCPGYNLGLKVIQASLANLIHGFNWSLPDNMTPEDLDMDEIFGLSTPKKFPLATVIEPRLSPKLYSV

SEQ ID NO: 564 - protein, 473 aa, Nicotiana tabacum
MQFFSLVSIFLFLAFLFLLRKWKNSNSQSKKLPPGPWKIPILGSMLHMIGGEPHHVLRDLAKKYGPLMHLQLGEISAVVVTSRDMAKEVLKTHDVVFASRPKIVAMDIICYNQSDIAFSPYGDHWRQMRKICVMELLNAKNVRSFSSIRRDEVVRLIDSIRSDSSSGELVNFTQRIIWFASSMTCRSAFGQVLKGQDIFAKKIREVIGLAEGFDVVDIFPTYKFLHVLSGMKRKLLNAHLKVDAIVEDVINEHKKNLAAGKSNGALEDMFAAGTETSSTTTVWAMAEMMKNPSVFTKAQAEVREAFRDKVSFDENDVEELKYLKLVIKETLRLHPPSPLLVPRECREDTDINGYTIPAKTKVMVNVWALGRDPKYWDDAESFKPERFEQCSVDFFGNNFEFLPFGGGRRICPGMSFGLANLYLPLAQLLYHFDWKLPTGIMPRDLDLTELSGITIARKGDLYLNATPYQPSRE

SEQ ID NO: 565 - protein, 519 aa, Nicotiana tabacum
MYHLLSPIEAIVGLVTFAFLLYLLWTKKQSKILNPLPPKIPGGWPVIGHLFYFNNNGDDDRHFSQKLGDLADKYGPVFTFRLGFRRFLAVSSYEAMKECFSTNDIHFADRPALLYGEYLCYNNAMLAVAKYGPYWKKNRKLVNQELLSVSRLEKFKHVRFSIVQKNIKQLYNCDSPMVKINLSDWIDKLTFDIILKMVVGKTYNNGHGEILKAAFQKFMVQAMEIELYDVFHIPFFKWLDLTGNIKAMKQTFKDIDNIIQGWLDEHIKKRETKDVGGENEQDFIDVLLSKRSNEHLGDGYSHDTTIKATVFTLVLDATDTLALHIKWVMALMINNKNVMKKAQEEMDTIVGRDRWVEENDIKNLVYLQAIVKEVLRLHPPAPLSVQHLSVKDCVVNGYHIPKGTALLTNIMKLQRDPQIWVDPDTFDPERFLTTNAAIDYRGQHYELIPFGSGRRACPAMNYSLQVEHLSIAHLIQGFNFATTTNEPLDMKQGVGLTLPKKTDVEVLITPRLPPTLYQY

SEQ ID NO: 566 - protein, 473 aa, Nicotiana tabacum
MEFFSLVSIFLFLSFLFLLRKCKNSNSQTKQLPPGPWKIPILGSMLHMLGGEPHHILRDLAKKYGPIMHLQFGEISAVVVTSREMAKEVLKTHDVVFASRPKIVAMDIICYNQSDIAFSPYGDHWRQMRKICVMELLNAKNVRSFSSIRRDEVVRLIDSIRSDSSSGELVNFTQRIIWFASSMTCRSAFGQVLKGQDVFAKKIREVIGLAEGFDVADIFPSYKFLHVLSGMKRKLLNAHLKVDAIVEDVINEHKKNLATGKTNGALGDMFAAGTETSSTTTVWAMAEMMKNPNVFNKAQAEVRETFKDKVTFDEIDAEELEYLKLVIKETLRLHPPSPLLVPRECREDTDINGYTIPAKTKVMVNVWALGRDPKYWDDAESFKPERFEQCSVDFFGNNFEFLPFGGGRRICPGMSFGLANLYLPLAQLLYHFDWKLPSGMMPGDLDLTELAGITIARKGDLYLMATPYQPSRE

SEQ ID NO: 567 - protein, 281 aa, Nicotiana tabacum
IDKLSGLTYRLERNFKDLDNFYEELIEQHQNPNKPKYMEGDIVDLLLQLKKEKLTPLDLTMEDIKGILMNVLVAGSDTSAAATVWAMTALIKNPKAMEKVQLEIRKSVGKKGIVNEEDVQNIPYFKAVIKEIFRLYPPAPLLVPRESMEKTILEGYEIRPRTIVHVNAWAIARDPEIWENPDEFIPERFLNSSIDYKGQDFELLPFGAGRRGCPGIALGVASMELALSNLLYAFDWELPYGVKKEDIDTNVRPGIAMHKKNELCLVPKKLFINYIGTWISC

SEQ ID NO: 568 - protein, 101 aa, Nicotiana tabacum
RDPKLWPNPDNFDPERFIAADIDFRGQHYEYIPFGSGRRSCPGMTYALQAEHLTMAHLIQGFNYRTPTNEPLDMKEGAGITIRKVNPVEVLIKPRLAPELY

SEQ ID NO: 569 - protein, 7 aa, Artificial Sequence
  Conserved P450 motif
  MISC_FEATURE (1)..(1): Xaa = Glu or Lys
  MISC_FEATURE (2)..(2): Xaa = any amino acid
  MISC_FEATURE (3)..(3): Xaa = any amino acid
  MISC_FEATURE (5)..(5): Xaa = any amino acid
  MISC_FEATURE (6)..(6): Xaa = any amino acid
  MISC_FEATURE (7)..(7): Xaa = Pro, Thr, Ser or Met
XXXRXXX

What is claimed is:

1. A method of identifying a *Nicotiana* plant, comprising the steps of:
   i) hybridizing, under stringent conditions, plant nucleic acid materials from *Nicotiana* plants to a nucleic acid probe that is 300 nucleotides or more in length, wherein said probe hybridizes to SEQ ID NO:183 under conditions that include a wash in 0.2×SSC at a temperature of 65° C.; and
   ii) identifying at least one of said plants that contains a full-length gene that hybridizes to SEQ ID NO:183 under conditions that include a wash in 0.2×SSC at a temperature of 65° C.

2. The method of claim 1, wherein said nucleic acid hybridization is Southern blot hybridization.

3. The method of claim 1, wherein said nucleic acid hybridization is Northern blot hybridization.

4. The method of claim 1, wherein said *Nicotiana* plants comprise one or more nonconverter plants.

5. The method of claim 1, wherein said *Nicotiana* plants comprise one or more converter plants.

6. The method of claim 1, further comprising the step of selecting said at least one identified plant as part of a breeding program.

7. The method of claim 1, further comprising the step of selecting said at least one identified plant as part of a mutagenesis program.

8. The method of claim 6, wherein said breeding program comprises using a traditional variety.

9. The method of claim 6, wherein said breeding program comprises using a transgenic variety.

10. The method of claim 1, wherein said plants comprise a plurality of *Nicotiana tabacum* plants.

11. The method of claim 10, further comprising the step of measuring the conversion of nicotine to nornicotine in said identified plant.

12. A method of identifying a *Nicotiana* plant, comprising the steps of:
   i) performing PCR on plant nucleic acid materials from *Nicotiana* plants for the presence of a full-length gene that hybridizes under stringent conditions to SEQ ID NO: 183, wherein said stringent conditions include a wash in 0.2×SSC at a temperature of 65° C.; and
   ii) identifying at least one of said plants that contains said full-length gene that hybridizes under said stringent conditions to SEQ ID NO:183.

13. The method of claim 12, wherein said *Nicotiana* plants comprise one or more nonconverter plants.

14. The method of claim 12, wherein said *Nicotiana* plants comprise one or more converter plants.

15. The method of claim 12, further comprising the step of selecting said at least one identified plant as part of a breeding program.

16. The method of claim 12, further comprising the step of selecting said at least one identified plant as part of a mutagenesis program.

17. The method of claim 15, wherein said breeding program comprises using a traditional variety.

18. The method of claim 15, wherein said breeding program comprises using a transgenic variety.

19. The method of claim 12, wherein said plants comprise a plurality of *Nicotiana tabacum* plants.

20. The method of claim 19, wherein said full-length gene contains a mutation in the nucleotide sequence set forth in SEQ ID NO:183.

21. The method of claim 20, wherein said mutation is a substitution in the nucleotide sequence set forth in SEQ ID NO:183.

22. The method of claim 19, further comprising the step of determining whether expression of said full-length gene is induced after ethylene treatment.

23. The method of claim 19, further comprising the step of measuring the conversion of nicotine to nornicotine in said identified plant.

24. A method of identifying a *Nicotiana* plant, comprising the steps of:
   i) hybridizing plant nucleic acids from *Nicotiana* plants to a high density oligonucleotide array, said array comprising oligonucleotide probes having nucleotide sequences from a full-length gene that hybridizes to SEQ ID NO:183 under stringent conditions that include a wash in 0.2×SSC at a temperature of 65° C.; and
   ii) identifying, based on signal intensity data generated by said hybridization, at least one of said *Nicotiana* plants that contains said full-length gene.

25. The method of claim 24, wherein said *Nicotiana* plants comprise one or more nonconverter plants.

26. The method of claim 24, wherein said *Nicotiana* plants comprise one or more converter plants.

27. The method of claim 24, further comprising the step of selecting said at least one identified plant as part of a breeding program.

28. The method of claim 24, further comprising the step of selecting said at least one identified plant as part of a mutagenesis program.

29. The method of claim 27, wherein said breeding program comprises using a traditional variety.

30. The method of claim 27, wherein said breeding program comprises using a transgenic variety.

31. The method of claim 24, wherein said plants comprise a plurality of *Nicotiana tabacum* plants.

32. The method of claim 31, wherein said full-length gene contains a mutation in the nucleotide sequence set forth in SEQ ID NO:183.

33. The method of claim 32, wherein said mutation is a substitution in the nucleotide sequence set forth in SEQ ID NO:183.

34. The method of claim 31, further comprising the step of determining whether expression of said full-length gene is induced after ethylene treatment.

35. The method of claim 31, further comprising the step of measuring the conversion of nicotine to nornicotine in said identified plant.

* * * * *